(12) United States Patent
Igawa et al.

(10) Patent No.: US 12,060,654 B2
(45) Date of Patent: Aug. 13, 2024

(54) LIGAND-BINDING MOLECULE HAVING ADJUSTABLE LIGAND BINDING ACTIVITY

(71) Applicant: CHUGAI SEIYAKU KABUSHIKI KAISHA, Tokyo (JP)

(72) Inventors: Tomoyuki Igawa, Shizuoka (JP); Hiroyuki Ishikawa, Shizuoka (JP)

(73) Assignee: Chugai Seiyaku Kabushiki Kaisha, Tokyo (JP)

( * ) Notice: Subject to any disclaimer, the term of this patent is extended or adjusted under 35 U.S.C. 154(b) by 1163 days.

(21) Appl. No.: 16/463,218

(22) PCT Filed: Nov. 28, 2017

(86) PCT No.: PCT/JP2017/042570
§ 371 (c)(1),
(2) Date: May 22, 2019

(87) PCT Pub. No.: WO2018/097308
PCT Pub. Date: May 31, 2018

(65) Prior Publication Data
US 2020/0207846 A1 Jul. 2, 2020

(30) Foreign Application Priority Data
Nov. 28, 2016 (JP) .................................. 2016-229882

(51) Int. Cl.
*C40B 40/10* (2006.01)
*C07K 16/24* (2006.01)
(Continued)

(52) U.S. Cl.
CPC ............ *C40B 40/10* (2013.01); *C07K 16/244* (2013.01); *C07K 16/2818* (2013.01); *C07K 16/2866* (2013.01); *A61K 2039/505* (2013.01)

(58) Field of Classification Search
CPC .................................................. C07K 16/244
See application file for complete search history.

(56) References Cited

U.S. PATENT DOCUMENTS 7,901,684 B2   3/2011  Gill et al.
8,809,504 B2   8/2014  Lauermann
(Continued)

FOREIGN PATENT DOCUMENTS

AU   2016213702 A1   8/2016
CA      2548338 A1   6/2005
(Continued)

OTHER PUBLICATIONS

Asano, R. and Kumagai, I., "Functionalization of Bispecific Therapeutic Antibodies Based on Protein Engineering," Yakugaku Zasshi, 135(7):851-856 (2015), with partial English translation.
(Continued)

*Primary Examiner* — Christian C Boesen
(74) *Attorney, Agent, or Firm* — Nixon & Vanderhye P.C.

(57) ABSTRACT

The present invention relates to a ligand binding molecule whose ligand binding activity is attenuated by the cleavage of a cleavage site and a method for producing the same, a complex formed by the ligand binding molecule and a ligand, a fusion protein comprising the ligand binding molecule and a ligand, and a pharmaceutical composition comprising the ligand binding molecule or a fusion protein of the ligand binding molecule and a ligand.

23 Claims, 59 Drawing Sheets
Specification includes a Sequence Listing.

(51) Int. Cl.
*C07K 16/28* (2006.01)
*A61K 39/00* (2006.01)

(56) References Cited

U.S. PATENT DOCUMENTS

| | | | |
|---|---|---|---|
| 10,357,571 | B2 | 7/2019 | Williams et al. |
| 10,568,977 | B2 | 2/2020 | Desnoyers et al. |
| 10,669,337 | B2 | 6/2020 | Irving et al. |
| 2004/0259768 | A1 | 12/2004 | Lauermann |
| 2007/0065878 | A1 | 3/2007 | Daugherty et al. |
| 2007/0243589 | A1 | 10/2007 | Gill et al. |
| 2011/0064666 | A1 | 3/2011 | Ogawa et al. |
| 2012/0244154 | A1 | 9/2012 | Daugherty et al. |
| 2015/0064169 | A1* | 3/2015 | Wang ............... C07K 16/36 536/23.53 |
| 2016/0144042 | A1 | 5/2016 | Williams et al. |
| 2016/0194399 | A1 | 7/2016 | Irving et al. |
| 2016/0289324 | A1 | 10/2016 | Moore et al. |
| 2018/0057593 | A1 | 3/2018 | Dennis |
| 2019/0359721 | A1 | 11/2019 | Igawa et al. |
| 2020/0369781 | A1 | 11/2020 | Igawa et al. |
| 2021/0155701 | A1 | 5/2021 | Hoshino et al. |
| 2022/0324975 | A1 | 10/2022 | Sakurai et al. |

FOREIGN PATENT DOCUMENTS

| | | |
|---|---|---|
| CA | 2591813 A1 | 6/2006 |
| CA | 2607147 A1 | 11/2006 |
| CA | 2666599 A1 | 2/2008 |
| CA | 2678626 A1 | 9/2008 |
| CA | 3041279 A1 | 5/2018 |
| CA | 3083346 A1 | 6/2019 |
| CN | 1665932 A | 9/2005 |
| CN | 101821288 A | 9/2010 |
| CN | 103068847 A | 4/2013 |
| CN | 103842383 A | 6/2014 |
| CN | 103958547 A | 7/2014 |
| CN | 104661676 A | 5/2015 |
| CN | 106459153 A | 2/2017 |
| CN | 107207564 A | 9/2017 |
| CN | 107602706 A | 1/2018 |
| CN | 103068847 B | 5/2019 |
| CN | 111836828 A | 10/2020 |
| CN | 107602706 B | 12/2020 |
| CN | 106459153 B | 12/2021 |
| CN | 114127277 A | 3/2022 |
| EP | 1505154 A1 | 2/2005 |
| EP | 2957633 A | 12/2015 |
| EP | 3546480 A1 | 10/2019 |
| EP | 3546574 A1 | 10/2019 |
| EP | 3556773 A1 | 10/2019 |
| EP | 3719036 A1 | 10/2020 |
| EP | 3981428 A1 | 4/2022 |
| JP | 2005168328 A | 6/2005 |
| JP | 2010536370 A | 12/2010 |
| JP | 2011026298 A | 2/2011 |
| JP | 2012514982 A | 7/2012 |
| JP | 2013538204 A | 10/2013 |
| JP | 2014509605 A | 4/2014 |
| JP | 2015509952 A | 4/2015 |
| JP | 2015517320 A | 6/2015 |
| JP | 5753903 B2 | 7/2015 |
| JP | 5765894 B2 | 8/2015 |
| JP | 5851842 B2 | 2/2016 |
| JP | 6035009 B2 | 11/2016 |
| JP | 6130307 B2 | 5/2017 |
| JP | 6178846 B2 | 8/2017 |
| JP | 2017523176 A | 8/2017 |
| JP | 2017529853 A | 10/2017 |
| JP | 6273215 B2 | 1/2018 |
| JP | 7020909 B2 | 2/2022 |
| RU | 2583876 C2 | 5/2016 |
| RU | 2015101803 A | 8/2016 |
| RU | 2636046 C2 | 11/2017 |
| WO | WO-2004021861 A2 | 3/2004 |
| WO | WO2005110453 A2 | 11/2005 |
| WO | WO-2007027935 A2 | 3/2007 |
| WO | WO-2007063308 A2 | 6/2007 |
| WO | WO2007063311 A2 | 6/2007 |
| WO | WO2008045148 A2 | 4/2008 |
| WO | WO-2008149149 A2 | 12/2008 |
| WO | WO2008157379 A2 | 12/2008 |
| WO | WO-2009021754 A2 | 2/2009 |
| WO | WO-2009025846 A2 | 2/2009 |
| WO | WO-2010081173 A2 | 7/2010 |
| WO | WO-2010115998 A2 | 10/2010 |
| WO | WO 2011020783 A3 | 2/2011 |
| WO | WO2011123683 A2 | 10/2011 |
| WO | WO-2012025525 A1 | 3/2012 |
| WO | WO2012028697 A1 | 3/2012 |
| WO | WO-2012123755 A1 | 9/2012 |
| WO | WO2012158818 A2 | 11/2012 |
| WO | WO2013046704 A2 | 4/2013 |
| WO | WO-2013128194 A1 | 9/2013 |
| WO | WO-2013148248 A1 | 10/2013 |
| WO | WO-2013176730 A1 | 11/2013 |
| WO | WO2013180834 A2 | 12/2013 |
| WO | WO2013192550 A2 | 12/2013 |
| WO | WO-2014052462 A2 | 4/2014 |
| WO | WO-2014125955 A1 | 8/2014 |
| WO | WO2015066279 A2 | 5/2015 |
| WO | WO-2015116933 A2 | 8/2015 |
| WO | WO2015117930 A1 | 8/2015 |
| WO | WO-2016014974 A2 | 1/2016 |
| WO | WO2016014974 A2 | 1/2016 |
| WO | WO-2016016269 A1 | 2/2016 |
| WO | WO-2016046778 A2 | 3/2016 |
| WO | WO2016077505 A2 | 5/2016 |
| WO | WO-2016118629 A1 | 7/2016 |
| WO | WO-2016179003 A1 | 11/2016 |
| WO | WO-2016182064 A1 | 11/2016 |
| WO | WO-2017025698 A1 | 2/2017 |
| WO | WO-2017162587 A1 | 9/2017 |
| WO | WO2017220990 A1 | 12/2017 |
| WO | WO2018085555 A1 | 5/2018 |
| WO | WO-2018097307 A1 | 5/2018 |
| WO | WO-2018097308 A1 | 5/2018 |
| WO | WO-2018220225 A1 | 12/2018 |
| WO | WO-2018220236 A1 | 12/2018 |
| WO | WO2019010219 A1 | 1/2019 |
| WO | WO2019010224 A1 | 1/2019 |
| WO | WO2019032471 A1 | 2/2019 |
| WO | WO-2019107380 A1 | 6/2019 |
| WO | WO-2019107384 A1 | 6/2019 |
| WO | WO2019132472 A1 | 7/2019 |
| WO | WO2019173832 A2 | 9/2019 |
| WO | WO2019222294 A1 | 11/2019 |
| WO | WO2019222295 A1 | 11/2019 |
| WO | WO2019222296 A1 | 11/2019 |
| WO | WO-2019230866 A1 | 12/2019 |
| WO | WO-2019230867 A1 | 12/2019 |
| WO | WO-2019230868 A1 | 12/2019 |
| WO | WO2020061526 A1 | 3/2020 |
| WO | WO2020069398 A1 | 4/2020 |
| WO | WO2020072821 A2 | 4/2020 |
| WO | WO-2020246567 A1 | 12/2020 |
| WO | WO2021016640 A1 | 1/2021 |
| WO | WO2021149697 A1 | 7/2021 |
| WO | WO2023002952 A1 | 1/2023 |

OTHER PUBLICATIONS

Gerspach, J., et al., "Target-selective activation on a TNF prodrug by urokinase-type plasminogen activator (uPA) mediated proteolytic processing at the cell surface," Cancer Immunol Immunother., 55:1590-1600 (2006).
Gladkov, O., et al., "Cyclophosphamide and tucotuzumab (huKS-IL2) following first-line chemotherapy in responding patients with extensive-disease small-cell lung cancer," Anti-Cancer Drugs, 26:1061-1068 (2015).
International Search Report in International Application No. PCT/JP2017/042570 dated Feb. 27, 2018, 3 pages.

(56) References Cited

OTHER PUBLICATIONS

Neri, D. and Sondel, P. M., "Immunocytokines for cancer treatment: past, present and future," Curr Opin Immunol., 40:96-102 (2016).

Paoloni, M., et al., "Defining the Pharmacodynamic Profiled and Therapeutic Index of NHS-IL12 Immunocytokine in Dogs with Malignant Melanoma," PLoS One, 10(6):e0129954 (2015).

Papadia, F., et al., "Isolated Limb Perfusion with the Tumor-Targeting Human Monoclonal Antibody-Cytokine Fusion Protein L19-TNF Plus Melphalan and Mild Hyperthermia in Patients with Locally Advanced Extremity Melanoma," J Surg Oncol., 107:173-179 (2013).

Pavlou, A. K. and Belsey, M. J., "The therapeutic antibodies market to 2008," Eur J Pharm Biopharmaceut., 59:389-396 (2005).

Puskas, J., et al., "Development of an attenuated interleukin-2 fusion protein that can be activated by tumour-expressed proteases," Immunol., 133:206-220 (2011).

Reichert, J. M., et al., "Monoclonal antibody successes in the clinic," Nat Biotechnol., 23(9):1073-1078 (2005).

Tzeng, A., et al., "Antigen specificity can be irrelevant to immunocytokine efficacy and biodistribution," PNAS, 112(11):3320-3325 (2015).

Van Roy, M., et al., "The preclinical pharmacology of the high affinity anti-IL-6R Nanobody® ALX-0061 supports its clinical development in rheumatoid arthritis," Arthitis Res Ther., 17:135, 16 pages (2015).

Weiner, L. M., et al., "Monoclonal antibodies: versatile platforms for cancer immunotherapy," Nat Rev Immunol., 10:317-327 (2010).

Yamane, B. H., et al., "The development of antibody-IL-2 based immunotherapy with hu14.18-IL2 (EMD-273063) in melanoma and neuroblastoma," Expert Opin Investig Drugs, 18(7):991-1000 (2009).

U.S. Appl. No. 16/767,085, 371(c) date May 26, 2020, Igawa, T., et al., related application.

U.S. Appl. No. 16/766,600, 371(c) date May 22, 2020, Igawa, T., et al., related application.

U.S. Appl. No. 16/463,222, 371(c) date May 22, 2019, Igawa, T., et al., related application.

U.S. Appl. No. 17/793,587, filed Jul. 18, 2022, Igawa et al.

Muller, S., et al., "Spliceosomal Peptide P140 for Immunotherapy of Systemic Lupus Erythematosus," Arthritis Rheum., 58(12):3873-3883 (2008).

Severin, Y. S., editor, "Biochemistry, Textbook for Higher Education," Moscow, Geotar-Med, 39-45 (2004).

Vignali, D. A. A. and Kuchroo, V. K., "IL-12 Family Cytokines: Immunological Playmakers," Nat Immunol., 13(8):722-728 (2012).

English translation of International Search Report dated Feb. 27, 2018 in International Appl. No. PCT/JP2017/042570, 3 pages.

English translation of International Preliminary Report on Patentability dated May 28, 2019 in International Appl. No. PCT/JP2017/042570, 7 pages.

Dinarello, C. A., et al., "Treating inflammation by blocking interleukin-1 in a broad spectrum of diseases," Nat Rev Drug Discov., 11(8):633-652 (2012).

Ishii-Watabe, A., et al., "A receptor involved in the regulation of the pharmacokinetics of antibody-based pharmaceuticals: FcRn," Folia Pharmacol Jpn., 136(5):280-284 (2010).

Sandersjöö, L., et al., "A new prodrug form of Affibody molecules (pro-Affibody) is selectively activated by cancer-associated proteases," Cell Mol Life Sci., 72:1405-1415 (2015).

Skrombolas, D., et al., "Development of an Interleukin-12 Fusion Protein That Is Activated by Cleavage with Matrix Metalloproteinase 9," J Interferon Cytokine Res., 39(4):233-245 (2019).

U.S. Appl. No. 17/793,587, filed Jul. 18, 2022, Igawa et al., related application.

U.S. Appl. No. 17/058,889, filed Nov. 25, 2020, Hoshino et al.

U.S. Appl. No. 17/058,896, filed Nov. 25, 2020, Ishikawa et al.

U.S. Appl. No. 17/058,961, filed Nov. 25, 2020, Kitamura et al.

U.S. Appl. No. 17/615,633, filed Dec. 1, 2021, Sakurai et al.

U.S. Appl. No. 17/477,983, filed Sep. 17, 2021, Igawa et al.

U.S. Appl. No. 16/767,085, 371(c) date May 26, 2020, Igawa, T., et al.

U.S. Appl. No. 16/766,600, 371(c) date May 22, 2020, Igawa, T., et al.

U.S. Appl. No. 16/463,222, 371(c) date May 22, 2019, Igawa, T., et al.

Knauf, M. J., et al., "Relationship of Effective Molecular Size to Systemic Clearance in Rats of Recombinant Interleukin-2 Chemically Modified with Water-soluble Polymers," J Biol Chem., 263(29):15064-15070 (1988).

Schlapschy, M., et al., "Fusion of a recombinant antibody fragment with a homo-amino-acid polymer: effects on biophysical properties and prolonged plasma half-life," Prot Eng Des Sel., 20(6):273-284 (2007).

Seliverstov, Y. A., et al., "Spinal muscular atrophies: conception, differential diagnostics and prospects for treatment," Nervous Diseases, 3:9-17 (2015).

Abstract of ACR/ARHP Annual Meeting, accessed at [https://plan.core-apps.com/tristar_acr17/abstract/7f9a3c05b0ca255af1fc655b034e5eaa], Accessed on Apr. 23, 2018.

Acchione, M., et al., "Impact of linker and conjugation chemistry on antigen binding, Fc receptor binding and thermal stability of model antibody-drug conjugates," mAbs, 4(3):362-372 (2012).

Alley, S.C., et al., "Antibody-Drug Conjugates: Targeted Drug Delivery for Cancer," Current Opinion in Chemical Biology, 14(4):529-537 (2010).

Baeuerle, P.A., et al., "BiTE: Teaching Antibodies to Engage T-cells for Cancer Therapy," Current Opinion in Molecular Therapeutics, 11(1):22-30 (2009).

Cohen, S.B., et al., "A Randomized, Double-blind Study of AMG 108 (a Fully Human Monoclonal Antibody to IL-1R1) in Patients With Osteoarthritis of the Knee," Arthritis Research & Therapy 13(4):R125 (2011).

De Bono, J.S., et al., "ING-1, A Monoclonal Antibody Targeting Ep-CAM in Patients With Advanced Adenocarcinomas," Clinical Cancer Research, 10(22):7555-7565 (2004).

Desjarlais, J.R., et al., "Optimizing Engagement of the Immune System by Anti-Tumor Antibodies: an Engineer's Perspective," Drug Discovery Today, 12(21-22):898-910 (2007).

Desnoyers, L.R., et al., "Tumor-specific Activation of an EGFR-targeting Probody Enhances Therapeutic Index," Science Translational Medicine, 5(207):207ra144 (2013).

Erster, O., et al., "Site-specific targeting of antibody activity in vivo mediated by disease-associated proteases," J Control Release, 161:804-812 (2012).

Halin, C., et al., "Synergistic Therapeutic Effects of a Tumor Targeting Antibody Fragment, Fused to Interleukin 12 and to Tumor Necrosis Factor α," Cancer Res., 63:3202-3210 (2003).

Harmsen, M., et al., "Selection and Optimization of Proteolytically Stable Llama Single-domain Antibody Fragments for Oral Immunotherapy," Applied Microbiology and Biotechnology, 72(3):544-551 (2006).

Hussack, G., et al., "Engineered Single-Domain Antibodies with High Protease Resistance and Thermal Stability," PLoS One, 6(11):e28218 (2011).

Juszczak, A., et al., "Ipilimumab: a Novel Immunomodulating Therapy Causing Autoimmune Hypophysitis: a Case Report and Review," European Journal of Endocrinology, 167(1):1-5 (2012).

Kiani, C., et al., "Structure and Function of Aggrecan," Cell Research, 12(1):19-32 (2002).

Kim, S.J., et al., "Antibody Engineering for the Development of Therapeutic Antibodies," Molecules and Cells, 20(1):17-29 (2005).

Kromann-Hansen, T., et al., "A Camelid-derived Antibody Fragment Targeting the Active Site of a Serine Protease Balances Between Inhibitor and Substrate Behavior," The Journal of Biology Chemistry, 291(29):15156-15168 (2016).

Lewis, G.D., et al., "Differential Responses of Human Tumor Cell Lines to Anti-p185HER2 Monoclonal Antibodies," Cancer Immunology, Immunotherapy, 37(4):255-263 (1993).

Lutterbuese, R., et al., "T Cell-Engaging BiTE Antibodies Specific for EGFR Potently Eliminate KRAS- and BRAF-Mutated Colorectal Cancer Cells," Proceedings of the National Academy of Sciences of the United States of America, 107(28):12605-12610 (2010).

Martel-Pelletier, J., et al., "Osteoarthritis," Nature Reviews Disease Primers 2:16072, Nature (2016).

(56) References Cited

OTHER PUBLICATIONS

Nam, J.L., et al., "Current Evidence for the Management of Rheumatoid Arthritis With Biological Disease-modifying Antirheumatic Drugs: a Systematic Literature Review Informing the EULAR Recommendations for the Management of RA," Annals of the Rheumatic Diseases, 69(6):976-986 (2010).
Polu, K.R., et al., "Probody Therapeutics for Targeting Antibodies to Diseased Tissue," Expert Opinion on Biological Therapy, 14(8):1049-1053 (2014).
"Human Aggrecan G1-IGD-G2 Domains Antibody," Monoclonal Mouse IgG2B Clone # 179509, Catalog No. MAB1220, R & D Systems, Feb. 2018, 1 Page.
Riechelmann, H., et al., "Phase I Trial With the CD44v6-Targeting Immunoconjugate Bivatuzumab Mertansine in Head and Neck Squamous Cell Carcinoma," Oral Oncology, 44(9):823-829 (2008).
Roitt, I., et al., Immunology, Moscow, Mir, 109-111 (2000), with corresponding English translation, Roitt, I., et al., Immunology, $5^{th}$ Edition, 78-81 (2000).
Satoh, M., et al., "Non-Fucosylated Therapeutic Antibodies as Next-Generation Therapeutic Antibodies," Expert Opinion on Biological Therapy, 6(11):1161-1173 (2006).
Takeuchi, T., et al., "The Japanese Experience With Biologic Therapies for Rheumatoid Arthritis," Nature Reviews. Rheumatology, 6(11):644-652 (2010).
Thomas, D.A., et al., "A Broad-spectrum Fluorescence-based Peptide Library for the Rapid Identification of Protease Substrates," Proteomics, 6(7):2112-2120 (2006).
Torres, M. and Casadevall, A., "The immunoglobulin constant region contributes to affinity and specificity," Trends Immunol., 29(2):91-97 (2008).
Trinh, V.A., et al., "Ipilimumab in the Treatment of Melanoma," Expert Opinion on Biological Therapy, 12(6):773-782 (2012).
Turk, B.E., et al., "Determination of Protease Cleavage Site Motifs Using Mixture-based Oriented Peptide Libraries," Nature Biotechnology, 19(7):661-667 (2001).
Wuest, T., et al., "TNF-Selectokine: a Novel Prodrug Generated for Tumor Targeting and Site-specific Activation of Tumor Necrosis Factor," Oncogene, 21(27):4257-4265 (2002).
Xia, B., et al., "Osteoarthritis Pathogenesis: a Review of Molecular Mechanisms," Calcified Tissue International, 95(6):495-505 (2014).
U.S. Appl. No. 10/651,584, filed Aug. 30, 2003, Lauermann.
U.S. Appl. No. 12/821,711, filed Jun. 23, 2010, Ogawa et al.
U.S. Appl. No. 17/058,889, filed Nov. 25, 2020, Hoshino et al., related application.
U.S. Appl. No. 17/058,896, filed Nov. 25, 2020, Ishikawa et al., related application.
U.S. Appl. No. 17/058,961, filed Nov. 25, 2020, Kitamura et al., related application.
U.S. Appl. No. 17/615,633, filed Dec. 1, 2021, Sakurai et al., related application.
U.S. Appl. No. 17/477,983, filed Sep. 17, 2021, Igawa et al., related application.
Abi-Habib, R. J., et al., "A urokinase-activated recombinant diphtheria toxin targeting the granulocyte-macrophage colony-stimulating factor receptor is selectively cytotoxic to human acute myeloid leukemia blasts," Blood, 104(7):2143-2148 (2004).
Alberts, B., et al., "Molecular Biology of the Cell," Fifth Edition, Chapter 3 "Proteins," 125, 136 (2008).
Chen, X., et al., "Fusion Protein Linkers: Property, Design and Functionality," Adv Drug Deliv Rev., 65(10):1357-1369 (2013).
Colman, P. M., "Effects of amino acid sequence changes on antibody-antigen interactions," Res Immunol., 145:33-36 (1994).
Dashivets, T., et al., "Oxidation in the complementarity-determining regions differentially influences the properties of therapeutic antibodies," MAbs, 8(8):1525-1535 (2016).
Derksen, P. W. B., et al., "Illegitimate WNT signaling promotes proliferation of multiple myeloma cells," PNAS, 101(16):6122-6127 (2004).
Dirks, P. B., "Brain Tumor Stem Cells: Bringing Order to the Chaos of Brain Cancer," J Clin Oncol., 26(17):2916-2924 (2008).
Drutskaya, M. S., et al., "Role of IL-6 in Experimental Arthritis Induced by Transfer of Arthritogenic Antibodies," Medical Immunology (Russia), 18(6):569-574 (2016).
Ginaldi, L., et al., "Increased levels of interleukin 31 (IL-31) in osteoporosis," BMC Immunol., 16:60 (2015).
Hutt, M., et al., "Plasma Half-life Extension of Small Recombinant Antibodies by Fusion to Immunoglobulin-binding Domains," J Biol Chem., 287(7):4462-4469 (2012).
Keskin, O., et al., "A new, structurally nonredundant, diverse data set of protein-protein interfaces and its implications," Protein Sci., 13:1043-1055 (2004).
López-Lázaro, M., "The migration ability of stem cells can explain the existence of cancer of unknown primary site. Rethinking metastasis." Oncoscience, 2(5):467-475 (2015).
Maeda, Y., et al., "Engineering of Functional Chimeric Protein G-VargulaLuciferase," Anal Biochem., 249(2):147-152 (1997).
Regsiter, A. and William, W., GenBank Accession No. SBV32674.1, May 15, 2017.
Rudikoff, S., et al. "Single amino acid substitution altering antigen-binding specificity," Proc Natl Acad Sci., 79:1979-1983 (1982).
Safdari, Y., et al., "Antibody humanization methods—a review and update," Biotechnol Genet Eng Rev., 29(2):175-186 (2013).
Takamori, A., et al., "IL-31 is crucial for induction of pruritus, but not inflammation, in contact hypersensitivity," Sci Rep., 8:6639 (2018).
Tran, B. and Rosenthal, M. A., "Survival comparison between glioblastoma multiforme and other incurable cancers," J Clin Neurosci., 17:417-421 (2010).
Wei, S., editor, "Chapter 10 Monoclonal Antibody-Based Targeted Therapy on Tumors, Section 1 Research on Engineered Antibody for Treating Tumors," Clinical Tumor Biological Immunotherapy, 186 (2006).
U.S. Appl. No. 17/615,748, filed Dec. 1, 2021, Sakurai, et al.
Allegra, C. J., et al., "Phase III Trial Assessing Bevacizumab in Stages II and III Carcinoma of the Colon: Results of NSABP Protocol C-08," J Clin Oncol., 29(1):11-16 (2011).
Badri, H., et al., "Optimization of radiation dosing schedules for proneural glioblastoma," J Math Biol., 72:1301-1336 (2016).
Baylot, V., et al., "TCTP Has a Crucial Role in the Different Stages of Prostate Cancer Malignant 4 Progression 5," TCTP/tpt1—Remodeling Signaling from Stem Cell to Disease. Results and Problems in Cell Differentiation, 64:255-261 (2017).
Mariuzza, R. A., et al., "The Structural Basis of Antigen-Antibody Recognition," Ann Rev Biophys Biophys Chem., 16:139-159 (1987).
Qin, Z.-X. and Liu, Z.-M., "The Research Progress in Yapsin Protease Family," Letters in Biotechnology, 19(4):591-596 (2008), with English abstract.
Roitt, I., et al., "Immunology," Fifth Edition, Moscow, Mir, 97-113 (2000).
Singer, M. and Berg, P., "Genes and Genomes," Moscow, Mir, 63 (1998).
Yarilin, A. A., Immunology Basics: Manual, Fundamentals of Immunology, Moscow, Medicina, 172-174 (1999).
U.S. Appl. No. 18/393,918, filed Dec. 22, 2023, Igawa et al., related application.
U.S. Appl. No. 18/580,385, filed Jan. 18, 2024, Chichili et al., related application.
U.S. Appl. No. 18/393,918, filed Dec. 22, 2023, Igawa et al.

\* cited by examiner (B) Heavy chain

| Heavy chain variant name | Protease cleavage sequence insertion position | Inserted sequence |
|---|---|---|
| EEIVHA | TVSS [insert] ASTKGP | LSGRSDNH (SEQ ID NO: 3) |
| EEIVHB | TVSSAS [insert] TKGP | LSGRSDNH (SEQ ID NO: 3) |
| EEIVHC | TV [insert] SSASTKGP | LSGRSDNH (SEQ ID NO: 3) |
| EEIVHD | TVS [insert] SASTKGP | LSGRSDNH (SEQ ID NO: 3) |
| EEIVHE | TVSSA [insert] STKGP | LSGRSDNH (SEQ ID NO: 3) |
| EEIVHF | TVSSAST [insert] KGP | LSGRSDNH (SEQ ID NO: 3) |
| EEIVHG | TVSSASTK [insert] GP | LSGRSDNH (SEQ ID NO: 3) |
| EEIVHBG | TVSSAS [insert] GKGP | LSGRSDNH (SEQ ID NO: 3) |
| EEIVHCG | TV [insert] GSASTKGP | LSGRSDNH (SEQ ID NO: 3) |
| EEIVHDG | TVS [insert] GASTKGP | LSGRSDNH (SEQ ID NO: 3) |
| EEIVHEG | TVSSA [insert] GTKGP | LSGRSDNH (SEQ ID NO: 3) |

FIG. 5B ( C ) Light chain

| Light chain variant name | Protease cleavage sequence insertion position | Inserted sequence |
|---|---|---|
| EEIVLA | VDIK [insert] RTVAAP | LSGRSDNH (SEQ ID NO: 3) |
| EEIVLB | VDIKRT [insert] VAAP | LSGRSDNH (SEQ ID NO: 3) |
| EEIVLC | VD [insert] IKRTVAAP | LSGRSDNH (SEQ ID NO: 3) |
| EEIVLD | VDI [insert] KRTVAAP | LSGRSDNH (SEQ ID NO: 3) |
| EEIVLE | VDIKR [insert] TVAAP | LSGRSDNH (SEQ ID NO: 3) |
| EEIVLF | VDIKRTV [insert] AAP | LSGRSDNH (SEQ ID NO: 3) |
| EEIVLG | VDIKRTVA [insert] AP | LSGRSDNH (SEQ ID NO: 3) |
| EEIVLEG | VDIKR [insert] GVAAP | LSGRSDNH (SEQ ID NO: 3) |

| Heavy chain variant name | Protease cleavage sequence insertion position | Inserted sequence |
|---|---|---|
| EEIVHC | TV [insert] SSASTKGP | LSGRSDNH (SEQ ID NO: 3) |
| EEIVHC002 | TV [insert] SSASTKGP | GLSGRSDNHG (SEQ ID NO: 28) |
| EEIVHC003 | TV [insert] SSASTKGP | SGLSGRSDNHGS (SEQ ID NO: 29) |
| EEIVHC004 | TV [insert] SSASTKGP | GSGLSGRSDNHGSS (SEQ ID NO: 30) |
| EEIVHC005 | TV [insert] SSASTKGP | GGSGLSGRSDNHGSSG (SEQ ID NO: 31) |
| EEIVHC006 | TV [insert] SSASTKGP | SGGSGLSGRSDNHGSSGT (SEQ ID NO: 32) |

| Heavy chain variant name | Insertion position and alteration position | Inserted sequence | Sequence after insertion and alteration |
|---|---|---|---|
| EESVHA009 | TVSS [insert] A-STKGP | GLSGRSDNHGS (SEQ ID NO: 61) | TVSSGLSGRSDNHGSSTKGP (SEQ ID NO: 62) |
| EESVHA012 | TVSS [insert] A-STKGP | GGSGLSGRSDNHGSSGT (SEQ ID NO: 63) | TVSSGGSGLSGRSDNHGSSGTSTKGP (SEQ ID NO: 64) |

FIG. 12

FIG. 26 (continued)
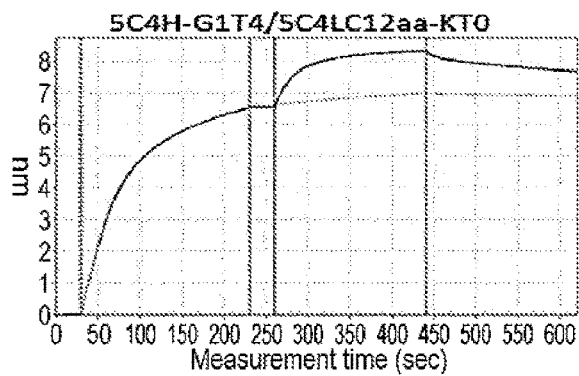
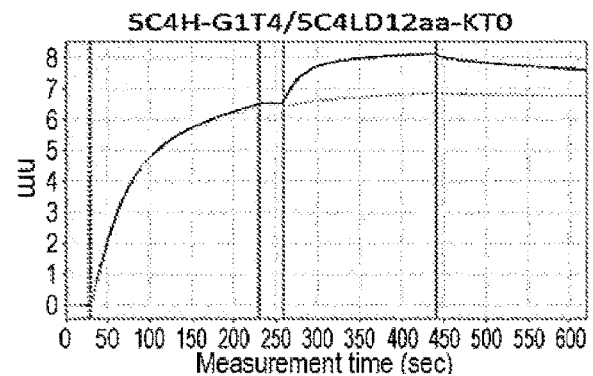
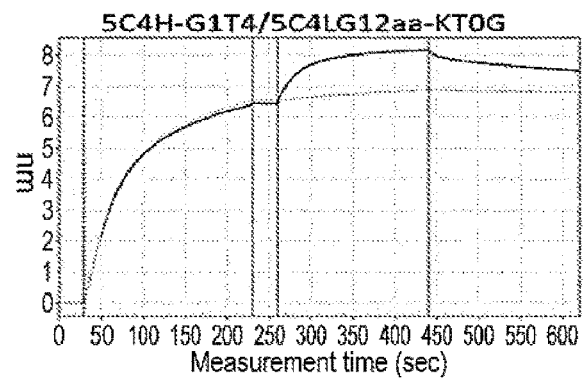
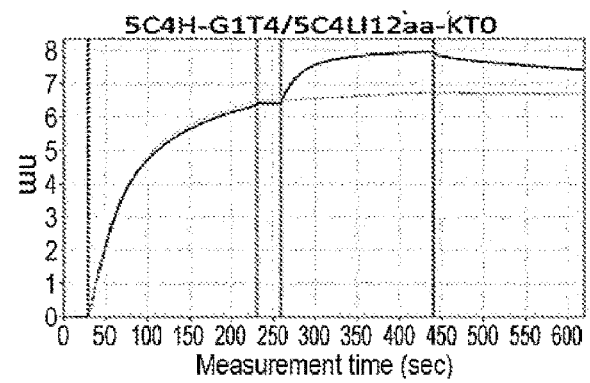
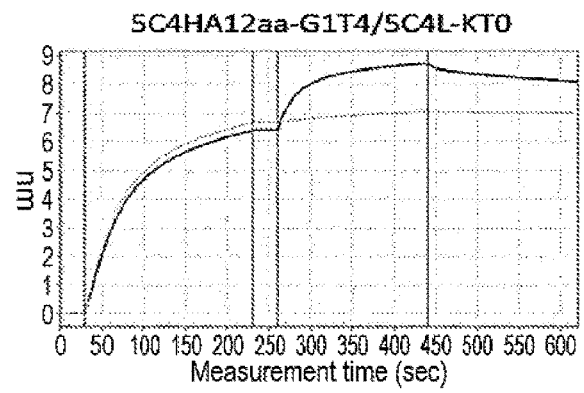
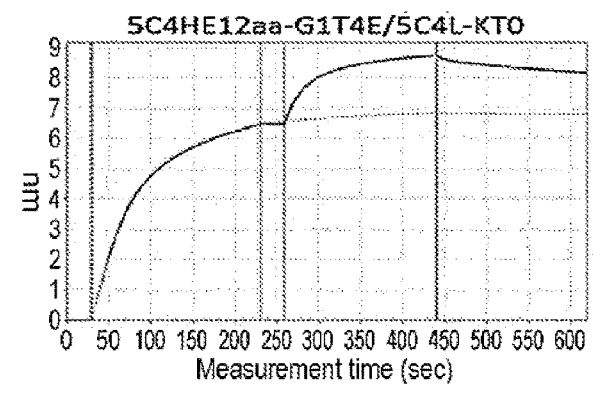

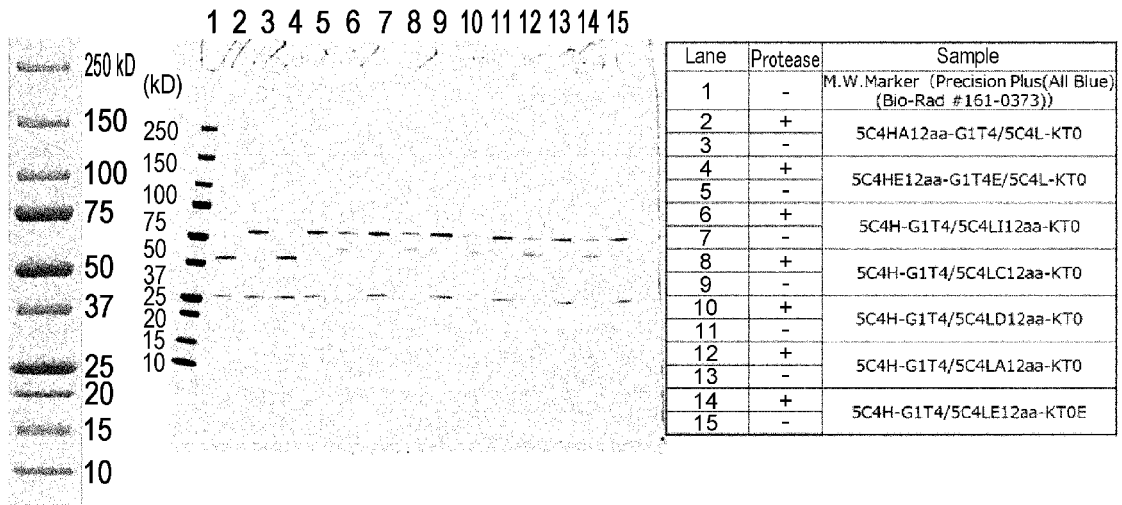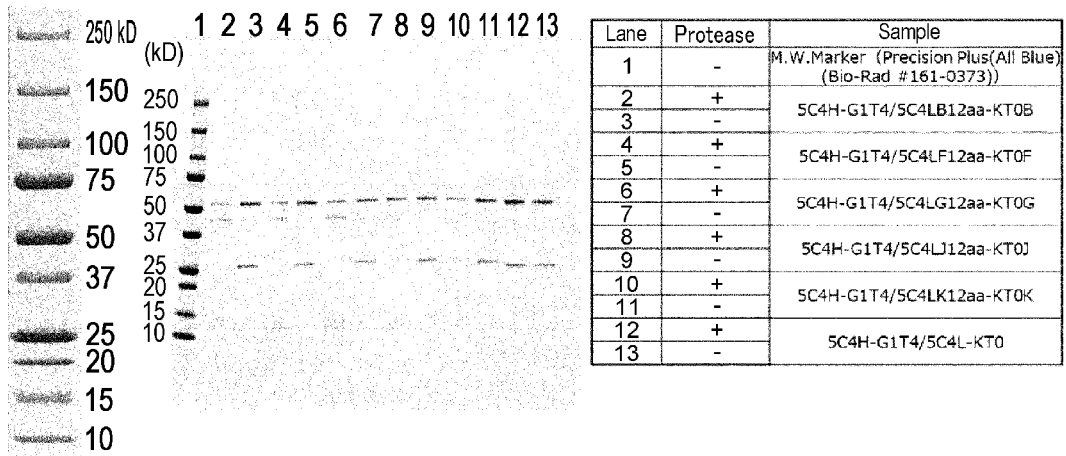
FIG. 27

FIG. 28 (continued)
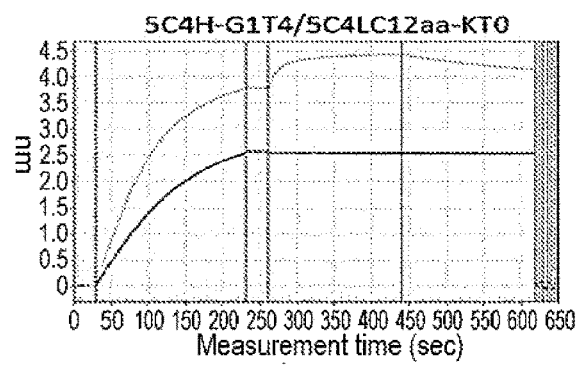
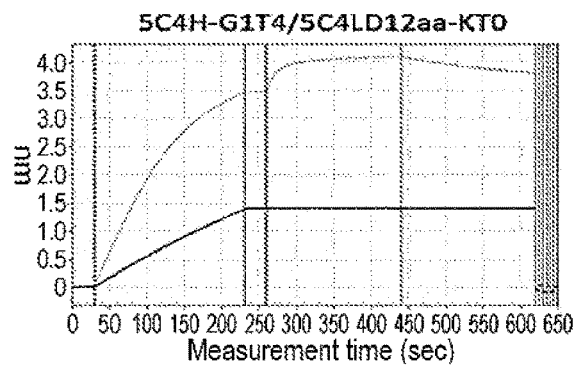
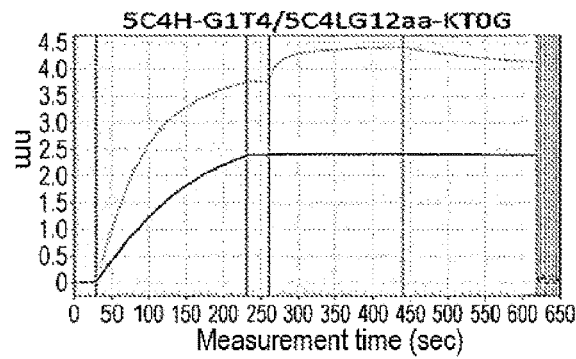
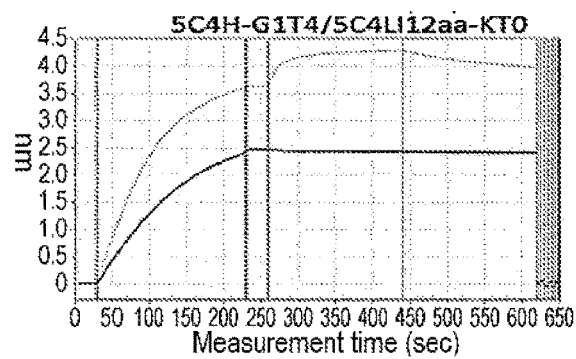
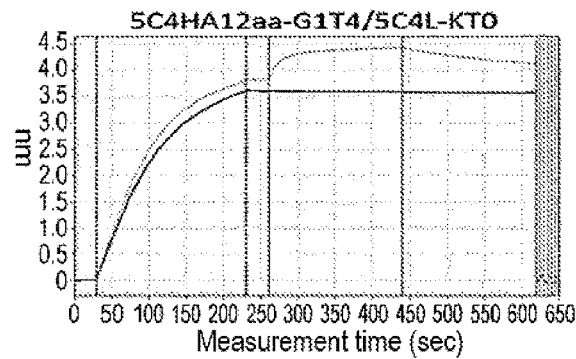
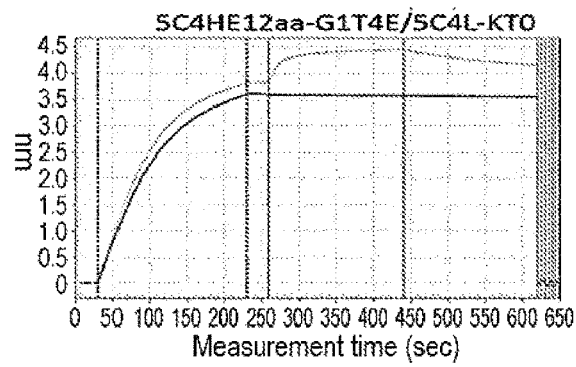

FIG. 29 (continued)
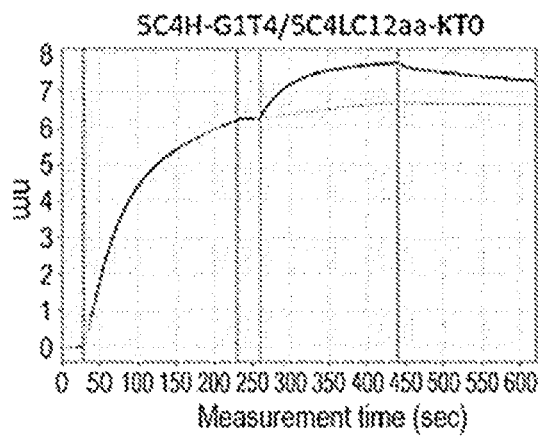
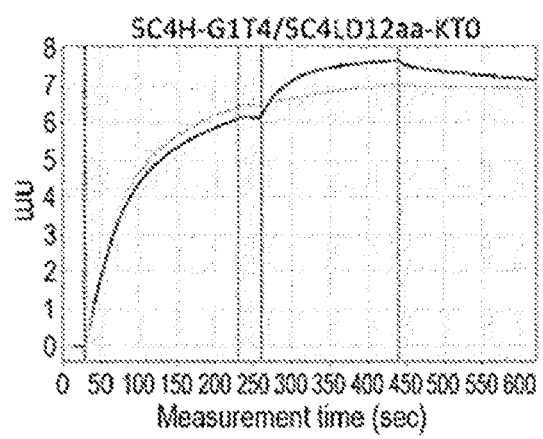
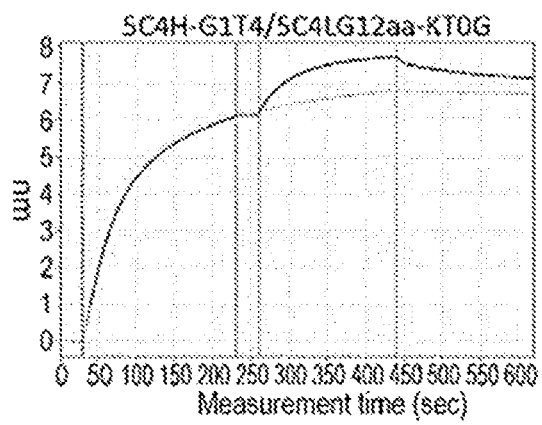
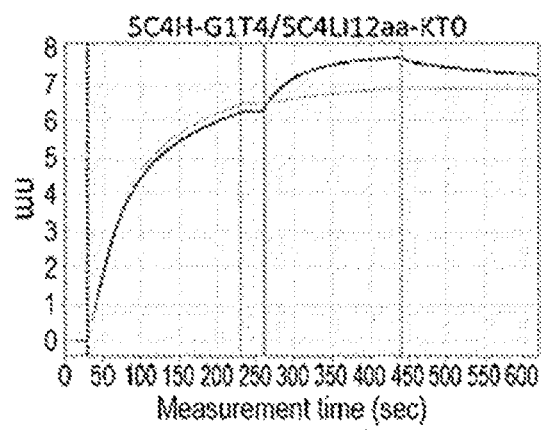
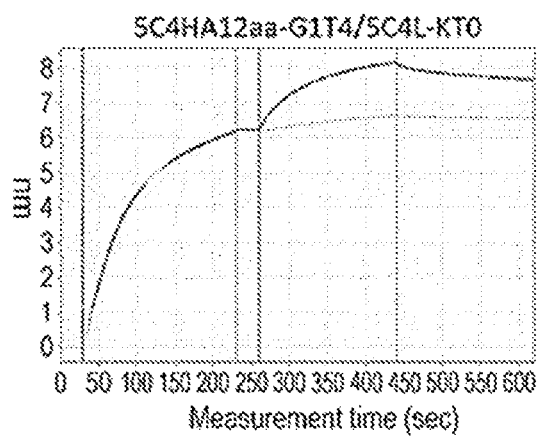
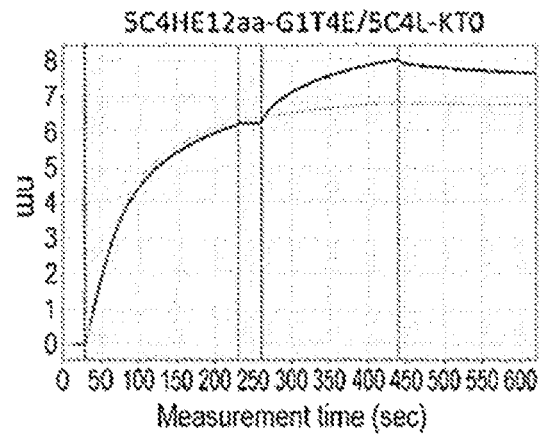

LIGAND-BINDING MOLECULE HAVING ADJUSTABLE LIGAND BINDING ACTIVITY

CROSS-REFERENCE TO RELATED APPLICATIONS

This application is a U.S. National Phase of PCT Application No. PCT/JP2017/042570, filed Nov. 28 2017, which claims priority to Japanese Patent Application No. 2016-0229882, filed Nov. 28, 2016, each of which is incorporated herein by reference.

REFERENCE TO SEQUENCE LISTING SUBMITTED ELECTRONICALLY

The content of the electronically submitted sequence listing (Name: 6663_0111_sequence_listing.txt; Size: 889 kilobytes; and Date of Creation: May 22, 2019) filed with the application is incorporated herein by reference in its entirety.

TECHNICAL FIELD

The present invention provides a ligand binding molecule having at least one cleavage site, wherein the ligand binding of the ligand binding molecule cleaved at the cleavage site is attenuated, a method for producing the ligand binding molecule, and a pharmaceutical composition comprising the ligand binding molecule.

BACKGROUND

Antibodies have received attention as drugs because of being highly stable in plasma and causing few adverse reactions. Among them, many IgG-type antibody drugs have been launched, and a large number of antibody drugs are currently under development (Non Patent Literatures 1 and 2).

Rituxan against CD20, cetuximab against EGFR, Herceptin against HER2, and the like have been approved so far as therapeutic drugs for cancer using antibody drugs (Non Patent Literature 3). These antibody molecules bind to their antigens expressed on cancer cells and thereby exert cytotoxic activity against the cancer cells through ADCC, signal inhibition, etc.

A method for delivering a ligand having physiological activity, such as a cytokine, to solid cancer by an immunocytokine containing the ligand fused with an antibody molecule binding to a cancer antigen highly expressed on cancer cells is also known. The cytokine delivered to solid cancer by the immunocytokine activates immunity and thereby exerts an antitumor effect. Since cytokines including IL2, IL12, and TNF have strong toxicity, it is expected for the local action of these cytokines on cancer that the local delivery to the cancer by an antibody strengthens their effects while alleviating adverse reactions (Non Patent Literatures 4, 5, and 6). However, all of these cytokines have not yet been approved as drugs because of their problems that, for example: they do not clinically exhibit a sufficient effect by systemic administration; their therapeutic windows are narrow; and they cannot be systemically administered due to strong toxicity.

This is largely because cytokines including immunocytokines, when systemically administered, are exposed to the whole bodies and are therefore capable of exhibiting toxicity by systemic action, or the cytokines can be administered only at very low doses in order to circumvent the toxicity. It has also been reported that an antitumor effect did not vary between an immunocytokine containing IL2 fused with an antibody binding to a cancer antigen and an immunocytokine containing IL2 fused with an antibody that does not bind to the cancer antigen (Non Patent Literature 7).

A molecule containing a cytokine and a cytokine receptor connected via a linker that is cleaved by protease highly expressed in cancer has been reported as a method for circumventing the problems described above. The cytokine is inhibited by the cytokine receptor connected therewith via the linker, while the cytokine is liberated from the cytokine receptor by the protease cleavage of the linker and thereby becomes an active form. As an example, a molecule containing TNF-alpha and TNF-R connected via a linker that is cleaved by uPA (Non Patent Literature 8) has been reported, and a molecule containing IL2 and IL2R connected via a linker that is cleaved by MMP2 (Non Patent Literature 9) has been reported. However, the cytokines in these molecules are active even before cleavage of the linker, and the cleavage of the linker improves the activity by only approximately 10 times. Also, a molecule containing IL2 connected with anti-IL2 scFv instead of IL2R via a linker that is cleaved by MMP-2 (Non Patent Literature 9) has been reported.

CITATION LIST

Non Patent Literature

[Non Patent Literature 1] Monoclonal antibody successes in the clinic. Janice M Reichert, Clark J Rosensweig, Laura B Faden & Matthew C Dewitz, Nat. Biotechnol. (2005) 23, 1073-1078

[Non Patent Literature 2] The therapeutic antibodies market to 2008. Pavlou A K, Belsey M J., Eur. J. Pharm. Biopharm. (2005) 59 (3), 389-396

[Non Patent Literature 3] Monoclonal antibodies: versatile platforms for cancer immunotherapy. Weiner L M, Surana R, Wang S., Nat. Rev. Immunol. (2010) 10 (5), 317-327

[Non Patent Literature 4] Cyclophosphamide and tucotuzumab (huKS-IL2) following first-line chemotherapy in responding patients with extensive-disease small-cell lung cancer. Gladkov O, Ramlau R, Serwatowski P, Milanowski J, Tomeczko J, Komarnitsky P B, Kramer D, Krzakowski M J. Anticancer Drugs. 2015 November; 26 (10): 1061-8.

[Non Patent Literature 5] Defining the Pharmacodynamic Profile and Therapeutic Index of NHS-IL12 Immunocytokine in Dogs with Malignant Melanoma. Paoloni M, Mazcko C, Selting K, Lana S, Barber L, Phillips J, Skorupski K, Vail D, Wilson H, Biller B, Avery A, Kiupel M, LeBlanc A, Bernhardt A, Brunkhorst B, Tighe R, Khanna C. PLoS One. 2015 Jun. 19; 10(6): e0129954.

[Non Patent Literature 6] Isolated limb perfusion with the tumor-targeting human monoclonal antibody-cytokine fusion protein L19-TNF plus melphalan and mild hyperthermia in patients with locally advanced extremity melanoma. Papadia F, Basso V, Patuzzo R, Maurichi A, Di Florio A, Zardi L, Ventura E, Gonzalez-Iglesias R, Lovato V, Giovannoni L, Tasciotti A, Neri D, Santinami M, Menssen H D, De Cian F. J Surg Oncol. 2013 February; 107 (2): 173-9.

[Non Patent Literature 7] Antigen specificity can be irrelevant to immunocytokine efficacy and biodistribution. Tzeng A, Kwan B H, Opel C F, Navaratna T, Wittrup K D. Proc Natl Acad Sci USA. 2015 Mar. 17; 112 (11): 3320-5.

[Non Patent Literature 8] Cancer Immunol Immunother. 2006 December; 55 (12): 1590-600. Epub 2006 Apr. 25. Target-selective activation of a TNF prodrug by urokinase-type plasminogen activator (uPA) mediated proteolytic processing at the cell surface. Gerspach J1, Nemeth J, Munkel S, Wajant H, Pfizenmaier K.

[Non Patent Literature 9] Immunology. 2011 June; 133 (2): 206-20. doi: 10.1111/j.1365-2567.2011.03428.x. Epub 2011 Mar. 23. Development of an attenuated interleukin-2 fusion protein that can be activated by tumour-expressed proteases. Puskas J1, Skrombolas D, Sedlacek A, Lord E, Sullivan M, Frelinger J.

SUMMARY

Technical Problem

The present invention has been made in light of these circumstances. An object of the present invention is to provide a ligand binding molecule that activates a ligand such as a cytokine or a chemokine selectively in a target tissue, a pharmaceutical composition comprising the ligand binding molecule, and methods for producing the pharmaceutical composition and the active ingredient.

Solution to Problem

The present inventors have conducted diligent studies to attain the object and consequently developed a ligand binding molecule whose ligand binding activity is attenuated by the cleavage of a cleavage site. The present inventors have also found that the ligand binding molecule or a pharmaceutical composition comprising the ligand binding molecule is useful in the treatment of a disease using the ligand and also found that: the ligand binding molecule or the pharmaceutical composition is useful in the treatment of a disease which involves administering the ligand binding molecule; and the ligand binding molecule is useful in the production of a drug for the treatment of a disease. The present inventors have also developed a method for producing the ligand binding molecule, completing the present invention.

The present invention is based on these findings and specifically encompasses exemplary embodiments described below.

(1) A ligand binding molecule which is a molecule capable of binding to a ligand, wherein the molecule is a polypeptide having at least one cleavage site, and the ligand binding of the molecule cleaved at the at least one cleavage site is attenuated.

(2) The ligand binding molecule according to (1), wherein the ligand is released from the ligand binding molecule cleaved at the cleavage site.

(3) The ligand binding molecule according to (1) or (2), wherein the cleavage site comprises a protease cleavage sequence.

(4) The ligand binding molecule according to (3), wherein the protease is a target tissue specific protease.

(5) The ligand binding molecule according to (4), wherein the target tissue is a cancer tissue, and the target tissue specific protease is a cancer tissue specific protease.

(6) The ligand binding molecule according to (4), wherein the target tissue is an inflammatory tissue, and the target tissue specific protease is an inflammatory tissue specific protease.

(7) The ligand binding molecule according to any of (3) to (6), wherein the protease is at least one protease selected from matriptase, urokinase (uPA), and metalloproteinase.

(8) The ligand binding molecule according to (3), wherein the protease cleavage sequence is a sequence comprising a sequence selected from the sequences represented by SEQ ID NOs: 3, 34, 66, 70, 71, 72, 73, 35, 75, 76, and 345.

(9) The ligand binding molecule according to any of (3) to (8), wherein a first flexible linker is further attached to one end of the protease cleavage sequence.

(10) The ligand binding molecule according to (9), wherein a second flexible linker is further attached to the other end of the protease cleavage sequence.

(11) The ligand binding molecule according to (9), wherein the first flexible linker is a flexible linker consisting of a glycine-serine polymer.

(12) The ligand binding molecule according to (10), wherein the second flexible linker is a flexible linker consisting of a glycine-serine polymer.

(13) The ligand binding molecule according to any of (1) to (12), wherein the ligand binding molecule comprises antibody VH, antibody VL, and an antibody constant region.

(14) The ligand binding molecule according to (13), wherein the cleavage site, or the protease cleavage sequence, or the protease cleavage sequence and the first flexible linker, or the protease cleavage sequence and the first flexible linker and the second flexible linker is located within the antibody constant region.

(15) The ligand binding molecule according to (14), wherein the cleavage site, or the protease cleavage sequence, or the protease cleavage sequence and the first flexible linker, or the protease cleavage sequence and the first flexible linker and the second flexible linker is inserted at any position in a sequence from antibody heavy chain constant region amino acid position 118 (EU numbering) to antibody heavy chain constant region amino acid position 140 (EU numbering).

(16) The ligand binding molecule according to (14), wherein the cleavage site, or the protease cleavage sequence, or the protease cleavage sequence and the first flexible linker, or the protease cleavage sequence and the first flexible linker and the second flexible linker is inserted at any position in a sequence from antibody light chain constant region amino acid position 108 (EU numbering) (Kabat numbering position 108) to antibody light chain constant region amino acid position 131 (EU numbering) (Kabat numbering position 131).

(17) The ligand binding molecule according to (13), wherein the cleavage site, or the protease cleavage sequence, or the protease cleavage sequence and the first flexible linker, or the protease cleavage sequence, the first flexible linker, and the second flexible linker are located within the antibody VH or within the antibody VL.

(18) The ligand binding molecule according to (17), wherein the cleavage site, or the protease cleavage sequence, or the protease cleavage sequence and the first flexible linker, or the protease cleavage sequence and the first flexible linker and the second flexible linker is inserted at any position in a sequence selected from the group consisting of a sequence from amino acid position 7 (Kabat numbering) to amino acid position 16 (Kabat numbering), a sequence from amino acid position 40 (Kabat numbering) to amino acid position 47 (Kabat numbering), a sequence from amino acid position 55 (Kabat numbering) to amino acid position 69 (Kabat numbering), a sequence from amino acid position 73 (Kabat numbering) to amino acid position 79 (Kabat numbering), a sequence from amino acid position 83 (Kabat numbering) to amino acid position 89 (Kabat numbering), a sequence from amino acid position 95 (Kabat numbering) to amino acid position 99 (Kabat numbering), and a sequence from amino acid position 101 (Kabat numbering) to amino acid position 113 (Kabat numbering) in the antibody VH.

(19) The ligand binding molecule according to (17), wherein the cleavage site, or the protease cleavage sequence, or the protease cleavage sequence and the first flexible linker, or the protease cleavage sequence and the first flexible linker and the second flexible linker is inserted at any position in a sequence selected from the group consisting of a sequence from amino acid position 7 (Kabat numbering) to amino acid position 19 (Kabat numbering), a sequence from amino acid position 39 (Kabat numbering) to amino acid position 46 (Kabat numbering), a sequence from amino acid position 49 (Kabat numbering) to amino acid position 62 (Kabat numbering), and a sequence from amino acid position 96 (Kabat numbering) to amino acid position 107 (Kabat numbering) in the antibody VL.

(20) The ligand binding molecule according to (13), wherein the cleavage site, or the protease cleavage sequence, or the protease cleavage sequence and the first flexible linker, or the protease cleavage sequence and the first flexible linker and the second flexible linker is located near the boundary between the antibody constant region and the antibody VH or/and near the boundary between the antibody constant region and the antibody VL.

(21) The ligand binding molecule according to (20), wherein the cleavage site, or the protease cleavage sequence, or the protease cleavage sequence and the first flexible linker, or the protease cleavage sequence and the first flexible linker and the second flexible linker is inserted at any position in a sequence from antibody VH amino acid position 109 (Kabat numbering) to antibody heavy chain constant region amino acid position 122 (EU numbering).

(22) The ligand binding molecule according to (20), wherein the cleavage site, or the protease cleavage sequence, or the protease cleavage sequence and the first flexible linker, or the protease cleavage sequence and the first flexible linker and the second flexible linker is inserted at any position in a sequence from antibody VL amino acid position 104 (Kabat numbering) to antibody light chain constant region amino acid position 113 (EU numbering) (Kabat numbering position 113).

(23) The ligand binding molecule according to any of (13) to (22), wherein the antibody VL and the antibody VH in the ligand binding molecule are associated with each other, wherein the association is canceled by the cleavage of the cleavage site or canceled by the protease cleavage of the protease cleavage sequence.

(24) The ligand binding molecule according to any of (1) to (23), wherein the ligand is a molecule having biological activity, and the ligand binding molecule inhibits the biological activity of the ligand by binding to the ligand.

(25) The ligand binding molecule according to any of (1) to (24), wherein the ligand is a cytokine or a chemokine.

(26) The ligand binding molecule according to any of (1) to (24), wherein the ligand is a ligand selected from an interleukin, an interferon, a hematopoietic factor, a member of the TNF superfamily, a chemokine, a cell growth factor, and a member of the TGF-β family.

(27) The ligand binding molecule according to any of (1) to (24), wherein the ligand is CXCL10, IL12, PD1, or IL6R.

(28) The ligand binding molecule according to (27), wherein the ligand is CXCL10, and the ligand binding molecule comprises antibody VH and antibody VL, wherein the ligand binding molecule has:

(a) antibody VH comprising H-CDR1 shown in SEQ ID NO: 374, H-CDR2 shown in SEQ ID NO: 375, and H-CDR3 shown in SEQ ID NO: 376, and antibody VL comprising L-CDR1 shown in SEQ ID NO: 377, L-CDR2 shown in SEQ ID NO: 378, and L-CDR3 shown in SEQ ID NO: 379;
(b) antibody VH comprising H-CDR1 shown in SEQ ID NO: 380, H-CDR2 shown in SEQ ID NO: 381, and H-CDR3 shown in SEQ ID NO: 382, and antibody VL comprising L-CDR1 shown in SEQ ID NO: 383, L-CDR2 shown in SEQ ID NO: 384, and L-CDR3 shown in SEQ ID NO: 385;
(c) antibody VH and antibody VL that compete with the antibody VH and the antibody VL described in (a) or (b); or
(d) antibody VH and antibody VL that bind to the same epitope as that for the antibody VH and the antibody VL described in (a) or (b).

(29) The ligand binding molecule according to (28), wherein the ligand binding molecule is an antibody comprising an antibody heavy chain selected from the sequences represented by SEQ ID NOs: 4 to 14, 23 to 27, 33, 59, 60, 356, and 367, or an antibody light chain selected from the sequences represented by SEQ ID NOs: 15 to 22.

(30) The ligand binding molecule according to (27), wherein the ligand is IL12, and the ligand binding molecule comprises antibody VH and antibody VL, wherein the ligand binding molecule has:

(a) antibody VH comprising H-CDR1 shown in SEQ ID NO: 386, H-CDR2 shown in SEQ ID NO: 387, and H-CDR3 shown in SEQ ID NO: 388, and antibody VL comprising L-CDR1 shown in SEQ ID NO: 389, L-CDR2 shown in SEQ ID NO: 390, and L-CDR3 shown in SEQ ID NO: 391;
(b) antibody VH and antibody VL that compete with the antibody VH and the antibody VL described in (a); or
(c) antibody VH and antibody VL that bind to the same epitope as that for the antibody VH and the antibody VL described in (a).

(31) The ligand binding molecule according to (30), wherein the ligand binding molecule is an antibody comprising an antibody heavy chain shown in SEQ ID NO: 146.

(32) The ligand binding molecule according to (27), wherein the ligand is PD1, and the ligand binding molecule comprises antibody VH and antibody VL, wherein the ligand binding molecule has:

(a) antibody VH comprising H-CDR1 shown in SEQ ID NO: 392, H-CDR2 shown in SEQ ID NO: 393, and H-CDR3 shown in SEQ ID NO: 394, and antibody VL comprising L-CDR1 shown in SEQ ID NO: 395, L-CDR2 shown in SEQ ID NO: 396, and L-CDR3 shown in SEQ ID NO: 397;
(b) antibody VH and antibody VL that compete with the antibody VH and the antibody VL described in (a); or
(c) antibody VH and antibody VL that bind to the same epitope as that for the antibody VH and the antibody VL described in (a).

(33) The ligand binding molecule according to (32), wherein the ligand binding molecule is an antibody comprising an antibody heavy chain selected from the sequences represented by SEQ ID NOs: 304 and 305, or an antibody light chain selected from the sequences represented by SEQ ID NOs: 306 to 315 and 322.

(34) The ligand binding molecule according to (27), wherein the ligand is IL-6R (IL-6 receptor), and the ligand binding molecule comprises antibody VH and antibody VL, wherein the ligand binding molecule has:

(a) antibody VH comprising H-CDR1 shown in SEQ ID NO: 398, H-CDR2 shown in SEQ ID NO: 399, and H-CDR3 shown in SEQ ID NO: 400, and antibody VL comprising L-CDR1 shown in SEQ ID NO: 401, L-CDR2 shown in SEQ ID NO: 402, and L-CDR3 shown in SEQ ID NO: 403;

(b) antibody VH and antibody VL that compete with the antibody VH and the antibody VL described in (a); or
(c) antibody VH and antibody VL that bind to the same epitope as that for the antibody VH and the antibody VL described in (a).
(35) The ligand binding molecule according to (34), wherein the ligand binding molecule is an antibody comprising an antibody heavy chain selected from the sequences represented by SEQ ID NOs: 153 to 156, 157 to 159, and 404 to 470, or an antibody light chain selected from the sequences represented by SEQ ID NOs: 471 to 535.
(36) The ligand binding molecule according to any of (1) to (35), wherein the ligand binding molecule is an IgG antibody.
(37) The ligand binding molecule according to any of (1) to (36), wherein the ligand binding molecule is bound with the ligand.
(38) The ligand binding molecule according to any of (1) to (36), wherein the ligand binding molecule is fused with the ligand.
(39) The ligand binding molecule according to (38), wherein the ligand binding molecule fused with the ligand does not further bind to another ligand.
(40) The ligand binding molecule according to (38) or (39), wherein the ligand binding molecule is fused with the ligand via a linker.
(41) The ligand binding molecule according to (40), wherein the linker does not comprise protease cleavage sequence.
(42) The ligand binding molecule according to any of (38) to (41), wherein the ligand is CXCL10, and the ligand binding molecule comprises an antibody light chain and an antibody heavy chain, wherein the antibody light chain or the antibody heavy chain is fused with the ligand.
(43) The ligand binding molecule according to (42), wherein the cleavage site is comprised in the antibody light chain or the antibody heavy chain.
(44) The ligand binding molecule according to (42) or (43), wherein the ligand is CXCL10, and the antibody light chain contained in the ligand binding molecule is fused with the ligand, wherein the ligand binding molecule has:
(a) an antibody heavy chain comprising H-CDR1 shown in SEQ ID NO: 374, H-CDR2 shown in SEQ ID NO: 375, and H-CDR3 shown in SEQ ID NO: 376, and an antibody light chain comprising L-CDR1 shown in SEQ ID NO: 377, L-CDR2 shown in SEQ ID NO: 378, and L-CDR3 shown in SEQ ID NO: 379; or
(b) an antibody heavy chain comprising H-CDR1 shown in SEQ ID NO: 380, H-CDR2 shown in SEQ ID NO: 381, and H-CDR3 shown in SEQ ID NO: 382, and an antibody light chain comprising L-CDR1 shown in SEQ ID NO: 383, L-CDR2 shown in SEQ ID NO: 384, and L-CDR3 shown in SEQ ID NO: 385.
(45) The ligand binding molecule according to any of (42) to (44), wherein the ligand is CXCL10 variant shown in SEQ ID NO: 370.
(46) The ligand binding molecule according to any of (38) to (41), wherein the ligand is PD1, and the ligand binding molecule comprises an antibody light chain and an antibody heavy chain, wherein the antibody light chain or the antibody heavy chain is fused with the ligand.
(47) The ligand binding molecule according to (46), wherein the cleavage site is comprised in the antibody light chain or the antibody heavy chain.
(48) The ligand binding molecule according to (46) or (47), wherein the ligand is PD1, the antibody light chain has L-CDR1 shown in SEQ ID NO: 395, L-CDR2 shown in SEQ ID NO: 396, and L-CDR3 shown in SEQ ID NO: 397, and the antibody heavy chain has H-CDR1 shown in SEQ ID NO: 392, H-CDR2 shown in SEQ ID NO: 393, and H-CDR3 shown in SEQ ID NO: 394.
(49) The ligand binding molecule according to any of (46) to (48), wherein the ligand is PD1 shown in SEQ ID NO: 320.
(50) The ligand binding molecule according to any of (46) to (49), wherein the ligand is PD1, and the antibody heavy chain contained in the ligand binding molecule is fused with the ligand, wherein a series of polypeptides of the antibody heavy chain fused with PD1 comprises a sequence selected from the sequences represented by SEQ ID NOs: 323 and 324.
(51) The ligand binding molecule according to any of (46) to (49), wherein the ligand is PD1, and the antibody light chain contained in the ligand binding molecule is fused with the ligand, wherein a series of polypeptides of the antibody light chain fused with PD1 comprises a sequence selected from the sequences represented by SEQ ID NOs: 325 to 334.
(52) The ligand binding molecule according to any of (38) to (41), wherein the ligand is IL12, and the ligand binding molecule comprises an antibody light chain and an antibody heavy chain, wherein the antibody light chain or the antibody heavy chain is fused with the ligand.
(53) The ligand binding molecule according to (52), wherein the cleavage site is comprised in the antibody light chain or the antibody heavy chain.
(54) The ligand binding molecule according to (52) or (53), wherein the ligand is IL12, the antibody light chain has L-CDR1 shown in SEQ ID NO: 389, L-CDR2 shown in SEQ ID NO: 390, and L-CDR3 shown in SEQ ID NO: 391, and the antibody heavy chain has H-CDR1 shown in SEQ ID NO: 386, H-CDR2 shown in SEQ ID NO: 387, and H-CDR3 shown in SEQ ID NO: 388.
(55) The ligand binding molecule according to any of (38) to (41), wherein the ligand is IL-6R, and the ligand binding molecule comprises an antibody light chain and an antibody heavy chain, wherein the antibody light chain or the antibody heavy chain is fused with the ligand.
(56) The ligand binding molecule according to (55), wherein the cleavage site is comprised in the antibody light chain or the antibody heavy chain.
(57) The ligand binding molecule according to (55) or (56), wherein the ligand is IL-6R, the antibody light chain has L-CDR1 shown in SEQ ID NO: 401, L-CDR2 shown in SEQ ID NO: 402, and L-CDR3 shown in SEQ ID NO: 403, and the antibody heavy chain has H-CDR1 shown in SEQ ID NO: 398, H-CDR2 shown in SEQ ID NO: 399, and H-CDR3 shown in SEQ ID NO: 400.
(58) A complex formed by a ligand and a ligand binding molecule according to any of (1) to (36) bound with the ligand.
(59) A fusion protein of a ligand binding molecule according to any of (1) to (36) fused with a ligand.
(60) The fusion protein according to (59), wherein the ligand binding molecule fused with the ligand does not further bind to another ligand.
(61) The fusion protein according to (59) or (60), wherein the ligand binding molecule is fused with the ligand via a linker.
(62) The fusion protein according to (61), wherein the linker does not comprise protease cleavage sequence.
(63) The fusion protein according to (61) or (62), wherein the linker is a linker consisting of a glycine-serine polymer.
(64) The fusion protein according to any of (59) to (63), wherein the ligand is CXCL10, and the ligand binding molecule comprises an antibody light chain and an antibody heavy chain, wherein the antibody light chain or the antibody heavy chain is fused with the ligand.

(65) The fusion protein according to (64), wherein the cleavage site is contained in the antibody light chain or the antibody heavy chain of the ligand binding molecule.

(66) The fusion protein according to (64) or (65), wherein the ligand is CXCL10, and the antibody light chain contained in the ligand binding molecule is fused with the ligand, wherein the ligand binding molecule has:

(a) an antibody heavy chain comprising H-CDR1 shown in SEQ ID NO: 374, H-CDR2 shown in SEQ ID NO: 375, and H-CDR3 shown in SEQ ID NO: 376, and an antibody light chain comprising L-CDR1 shown in SEQ ID NO: 377, L-CDR2 shown in SEQ ID NO: 378, and L-CDR3 shown in SEQ ID NO: 379; or (b) an antibody heavy chain comprising H-CDR1 shown in SEQ ID NO: 380, H-CDR2 shown in SEQ ID NO: 381, and H-CDR3 shown in SEQ ID NO: 382, and an antibody light chain comprising L-CDR1 shown in SEQ ID NO: 383, L-CDR2 shown in SEQ ID NO: 384, and L-CDR3 shown in SEQ ID NO: 385.

(67) The fusion protein according to any of (64) to (66), wherein the ligand is CXCL10 variant shown in SEQ ID NO: 370.

(68) The fusion protein according to any of (59) to (63), wherein the ligand is PD1, and the ligand binding molecule comprises an antibody light chain and an antibody heavy chain, wherein the antibody light chain or the antibody heavy chain is fused with the ligand.

(69) The ligand binding molecule according to (68), wherein the cleavage site is contained in the antibody light chain or the antibody heavy chain.

(70) The fusion protein according to (68) or (69), wherein the ligand is PD1, the antibody light chain has L-CDR1 shown in SEQ ID NO: 395, L-CDR2 shown in SEQ ID NO: 396, and L-CDR3 shown in SEQ ID NO: 397, and the antibody heavy chain has H-CDR1 shown in SEQ ID NO: 392, H-CDR2 shown in SEQ ID NO: 393, and H-CDR3 shown in SEQ ID NO: 394.

(71) The fusion protein according to any of (68) to (70), wherein the ligand is PD1 shown in SEQ ID NO: 320.

(72) The fusion protein according to any of (68) to (71), wherein the ligand is PD1, and the antibody heavy chain contained in the ligand binding molecule is fused with the ligand, wherein a series of polypeptides of the antibody heavy chain fused with PD1 comprises a sequence selected from the sequences represented by SEQ ID NOs: 323 and 324.

(73) The fusion protein according to any of (68) to (71), wherein the ligand is PD1, and the antibody light chain contained in the ligand binding molecule is fused with the ligand, wherein a series of polypeptides of the antibody light chain fused with PD1 comprises a sequence selected from the sequences represented by SEQ ID NOs: 325 to 334.

(74) The fusion protein according to any of (59) to (63), wherein the ligand is IL12, and the ligand binding molecule comprises an antibody light chain and an antibody heavy chain, wherein the antibody light chain or the antibody heavy chain is fused with the ligand.

(75) The fusion protein according to (74), wherein the cleavage site is comprised in the antibody light chain or the antibody heavy chain.

(76) The fusion protein according to (74) or (75), wherein the ligand is IL12, the antibody light chain has L-CDR1 shown in SEQ ID NO: 389, L-CDR2 shown in SEQ ID NO: 390, and L-CDR3 shown in SEQ ID NO: 391, and the antibody heavy chain has H-CDR1 shown in SEQ ID NO: 386, H-CDR2 shown in SEQ ID NO: 387, and H-CDR3 shown in SEQ ID NO: 388.

(77) The fusion protein according to any of (59) to (63), wherein the ligand is IL-6R, and the ligand binding molecule comprises an antibody light chain and an antibody heavy chain, wherein the antibody light chain or the antibody heavy chain is fused with the ligand.

(78) The fusion protein according to (77), wherein the cleavage site is comprised in the antibody light chain or the antibody heavy chain.

(79) The fusion protein according to (77) or (78), wherein the ligand is IL-6R, the antibody light chain has L-CDR1 shown in SEQ ID NO: 401, L-CDR2 shown in SEQ ID NO: 402, and L-CDR3 shown in SEQ ID NO: 403, and the antibody heavy chain has H-CDR1 shown in SEQ ID NO: 398, H-CDR2 shown in SEQ ID NO: 399, and H-CDR3 shown in SEQ ID NO: 400.

(80) A pharmaceutical composition comprising a ligand binding molecule according to any of (1) to (57).

(81) A pharmaceutical composition comprising a ligand binding molecule according to any of (1) to (37) and a ligand.

(82) A pharmaceutical composition comprising a complex according to (58).

(83) A pharmaceutical composition comprising a fusion protein according to any of (59) to (79).

(84) A method for producing a ligand binding molecule according to any of (1) to (57).

(85) The production method according to (84), comprising introducing a protease cleavage sequence into a molecule capable of binding to a ligand.

(86) A method for producing a fusion protein according to any of (59) to (79), comprising fusing a ligand binding molecule having a protease cleavage sequence with its ligand.

(87) A polynucleotide encoding a ligand binding molecule according to any of (1) to (57).

(88) A vector comprising a polynucleotide according to (87).

(89) A host cell comprising a polynucleotide according to (87) or a vector according to (88).

(90) A method for producing a ligand binding molecule according to any of (1) to (57), comprising the step of culturing a host cell according to (89).

(91) A polynucleotide encoding a fusion protein according to any of (59) to (79).

(92) A vector comprising a polynucleotide according to (91).

(93) A host cell comprising a polynucleotide according to (91) or a vector according to (92).

(94) A method for producing a fusion protein according to any of (59) to (79), comprising the step of culturing a host cell according to (93).

BRIEF DESCRIPTION OF DRAWINGS

FIG. 5B is a diagram showing the name of each prepared heavy chain variant, the insertion position of the protease cleavage sequence, and the inserted amino acid sequence. The insertion site is indicated by [insert].

FIG. 5C is a diagram showing the name of each prepared light chain variant, the insertion position of the protease cleavage sequence, and the inserted amino acid sequence. The insertion site is indicated by [insert].

FIG. 7-1 is a diagram showing (A) results of evaluating the degree of cleavage by migration in reducing SDS-PAGE and detection with Coomassie Brilliant Blue (CBB) after protease (MT-SP1) treatment of antibody molecules prepared by inserting a protease cleavage sequence near the boundary between the heavy chain variable region and constant region of MabCXCL10. Of two new bands resulting from the protease treatment, the band appearing around 15 kDa is a band derived from the VH, and the band appearing around 25 to 50 kDa is a band derived from the constant region.

FIG. 7-2 is a diagram showing a continuation of (A) and (B) results of evaluating the degree of cleavage by reducing SDS-PAGE after protease (MT-SP1) treatment of antibody molecules prepared by inserting a protease cleavage sequence into the light chain variable region or constant region of MabCXCL10. The protease treatment generated two new bands derived from the cleaved light chain.

FIG. 7-3 is a diagram showing a continuation of (B).

FIG. 8 is a diagram showing the name of each heavy chain variant prepared by inserting a protease cleavage sequence and a flexible linker sequence near the boundary between the variable and constant regions of MabCXCL10, the insertion position of the protease cleavage sequence and the flexible linker sequence, and the inserted amino acid sequence. The insertion site is indicated by [insert].

FIG. 12 is a diagram showing the name of each heavy chain prepared by substituting a portion of an amino acid sequence near the boundary between the variable and constant regions of MabCXCL10 by a protease cleavage sequence and a flexible linker sequence, the amino acid insertion and alteration sites, the inserted sequence, and the amino acid sequence after the insertion and the alteration. The insertion site is indicated by [insert]. The amino acid residues indicated by strike-through in the column "Insertion position and alteration position" were removed, i.e., substituted by the C-terminal first amino acid of the inserted sequence, at the time of insertion of the inserted sequence.

FIG. 19A is a diagram showing the protease cleavage of an antibody.

FIG. 19B is a diagram showing the protease cleavage of an antibody.

FIG. 20A is a diagram showing results of cleavage by various proteases.

FIG. 20B is a diagram showing results of cleavage by various proteases.

Figure 21:
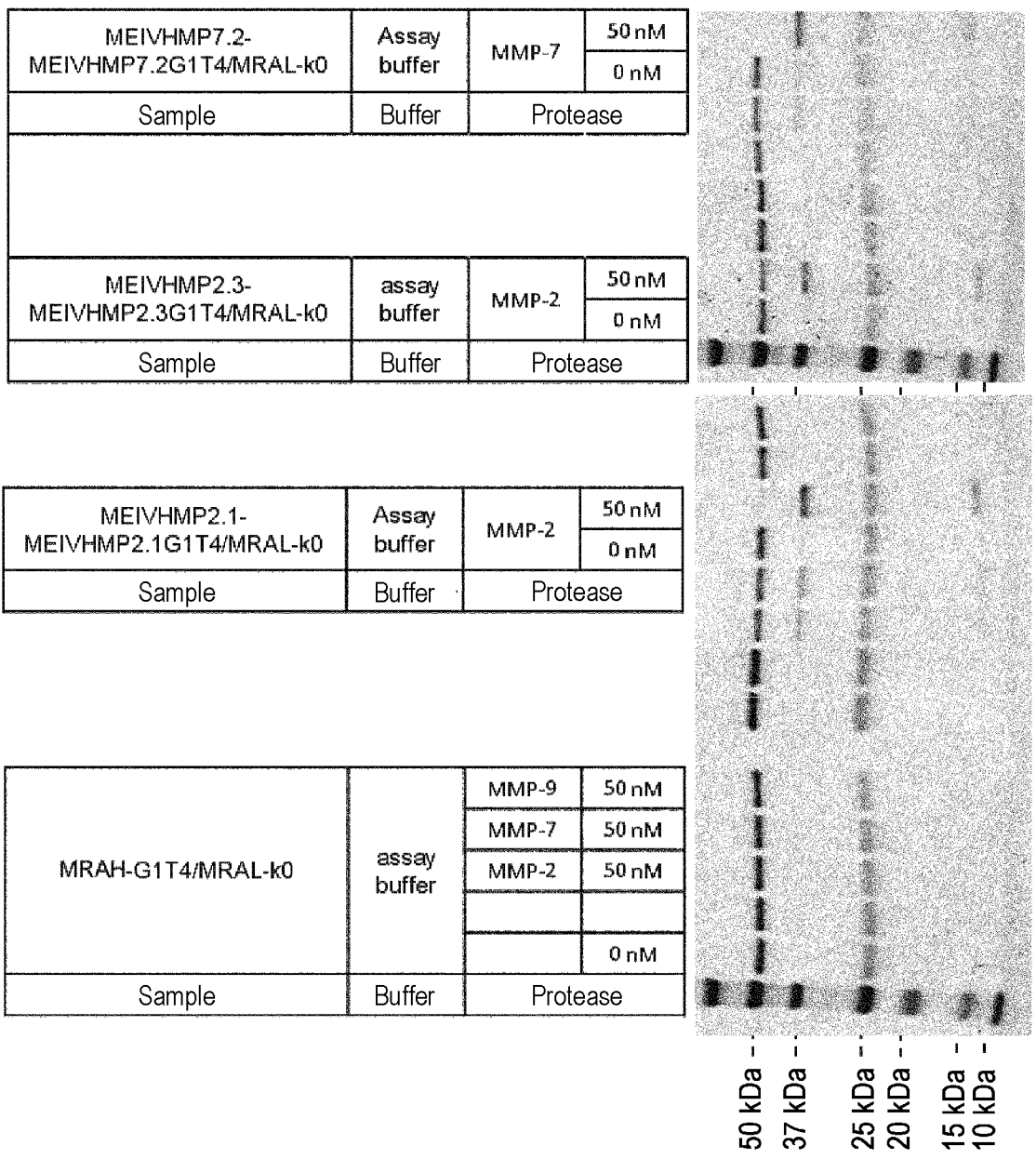

FIG. 21 is a diagram showing results of cleavage by various proteases.

Figure 22A:
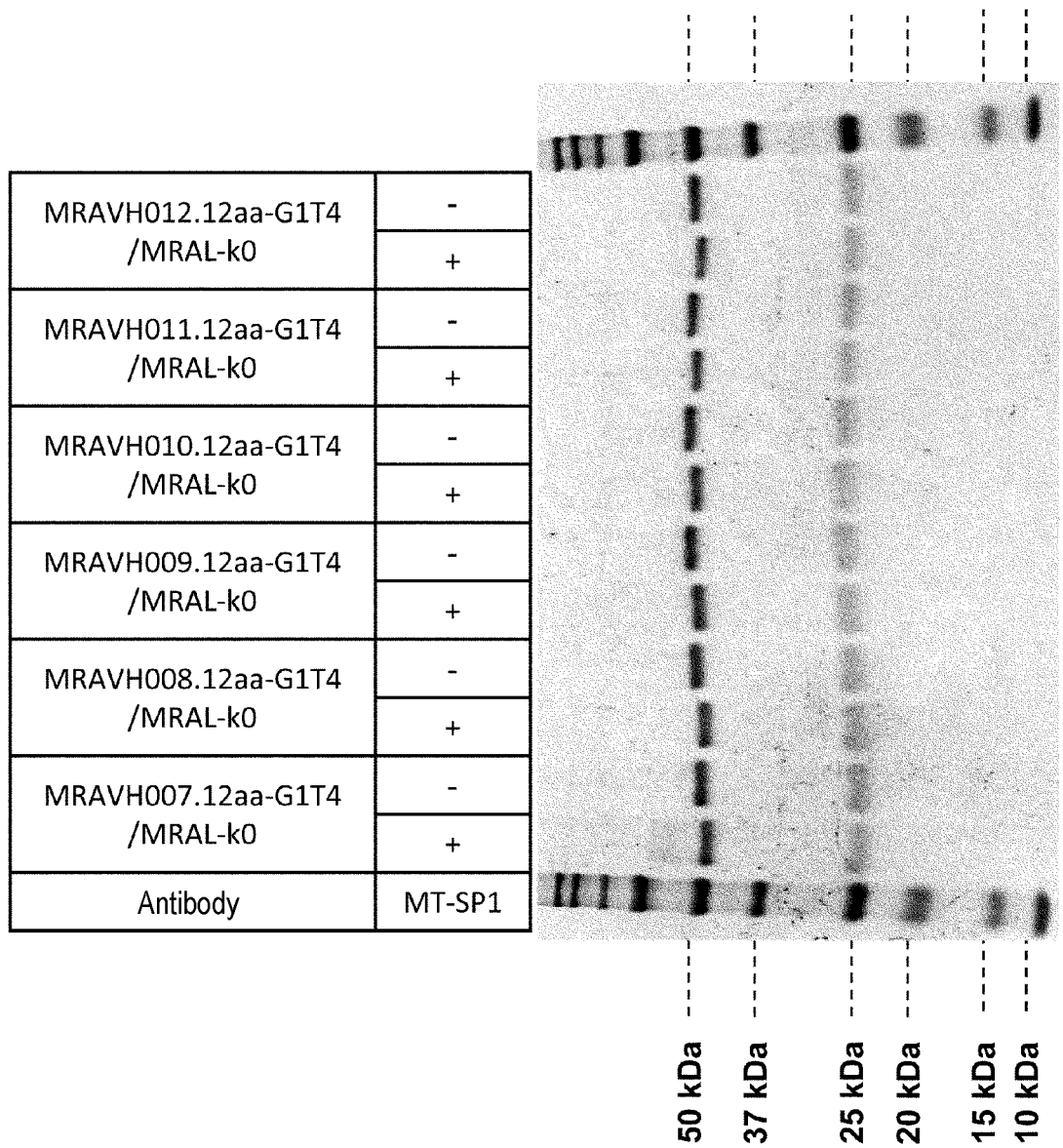

FIG. 22A is a diagram showing results of cleaving MRA antibody variants by protease.

Figure 22B:
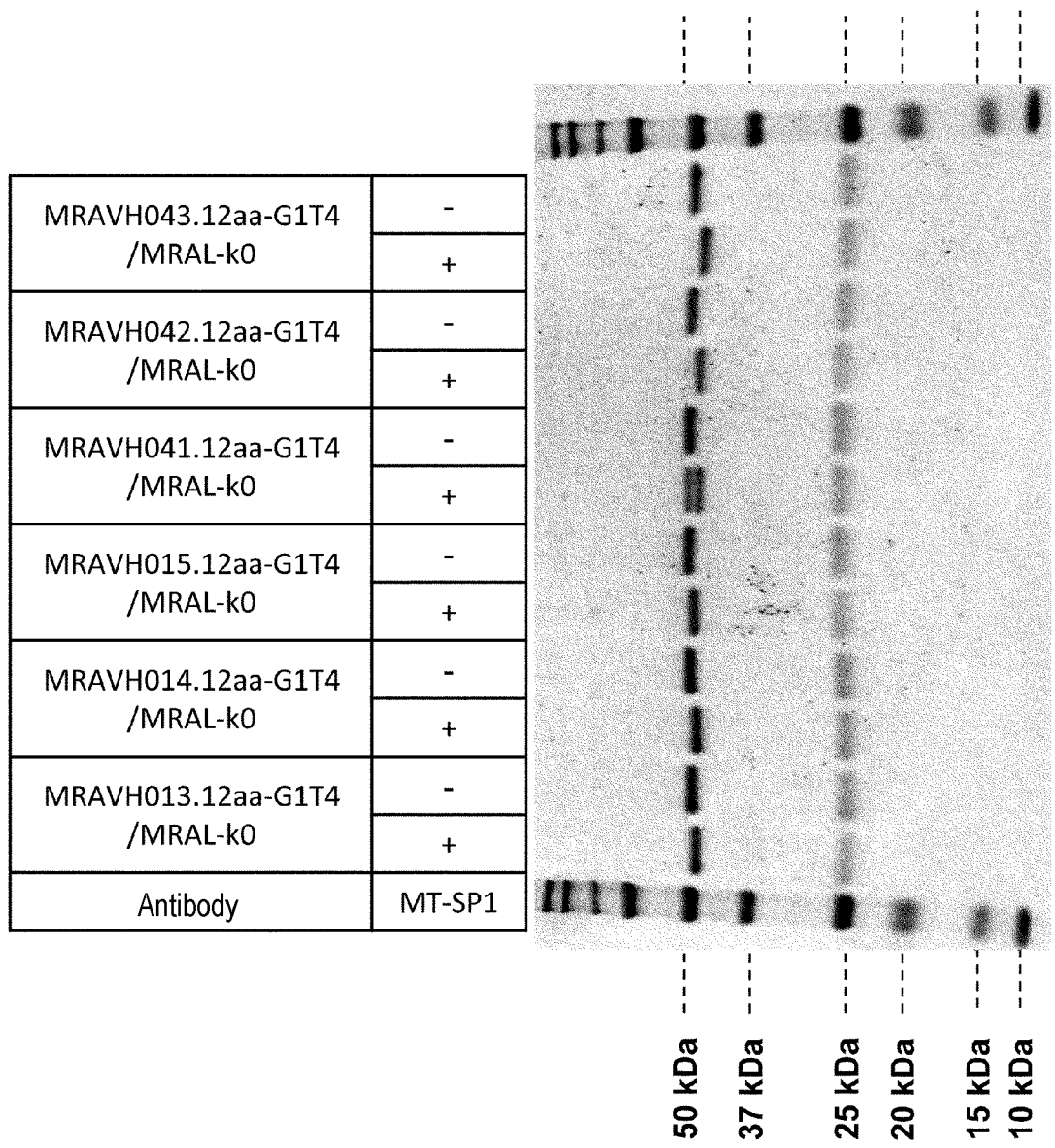

FIG. 22B is a diagram showing results of cleaving MRA antibody variants by protease.

Figure 22C:
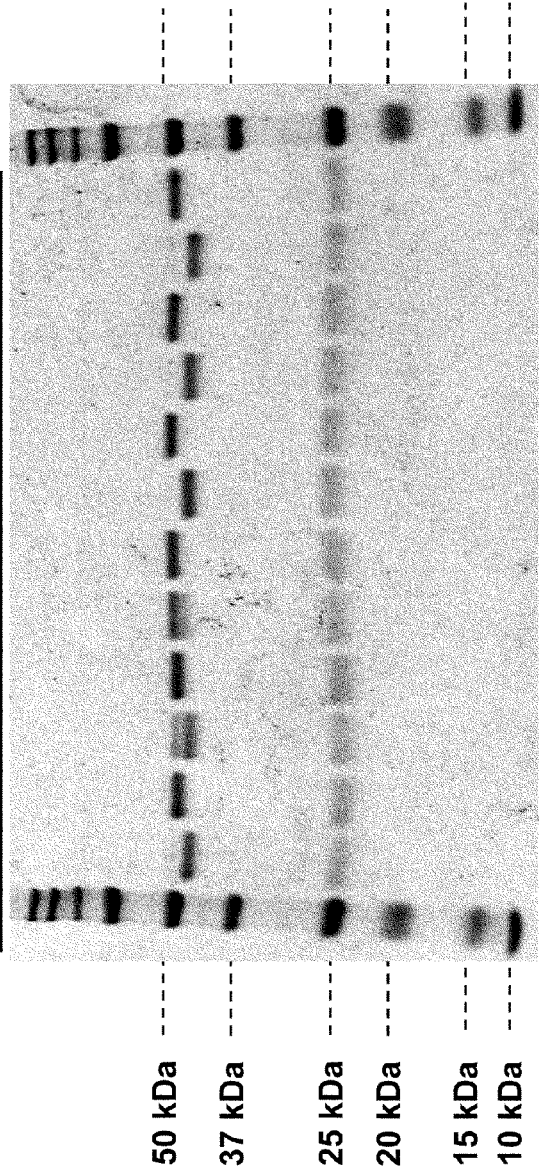

FIG. 22C is a diagram showing results of cleaving MRA antibody variants by protease.

Figure 22D:
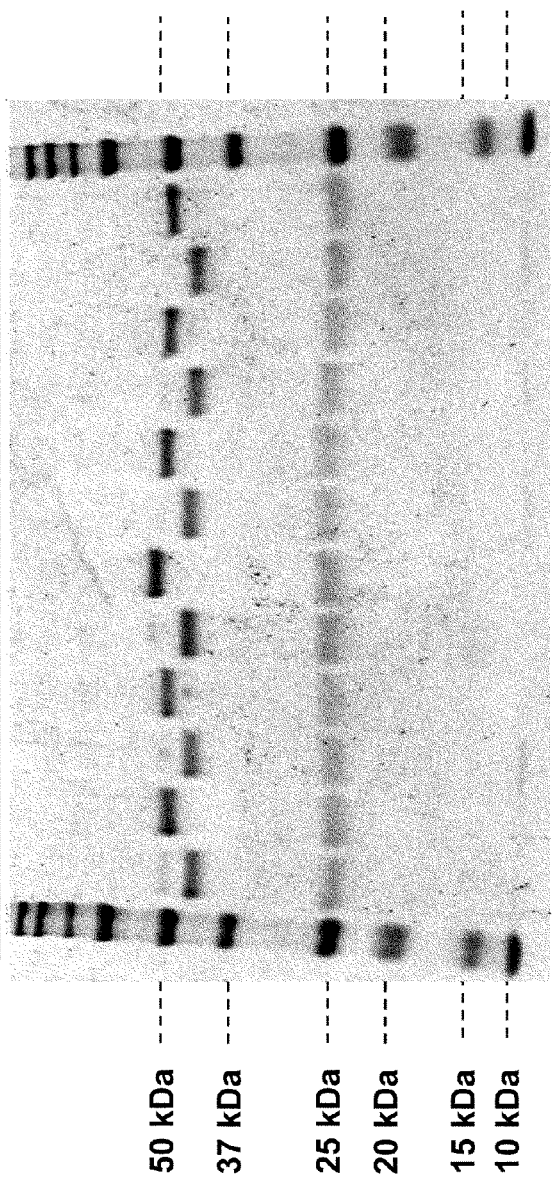

FIG. 22D is a diagram showing results of cleaving MRA antibody variants by protease.

Figure 22E:
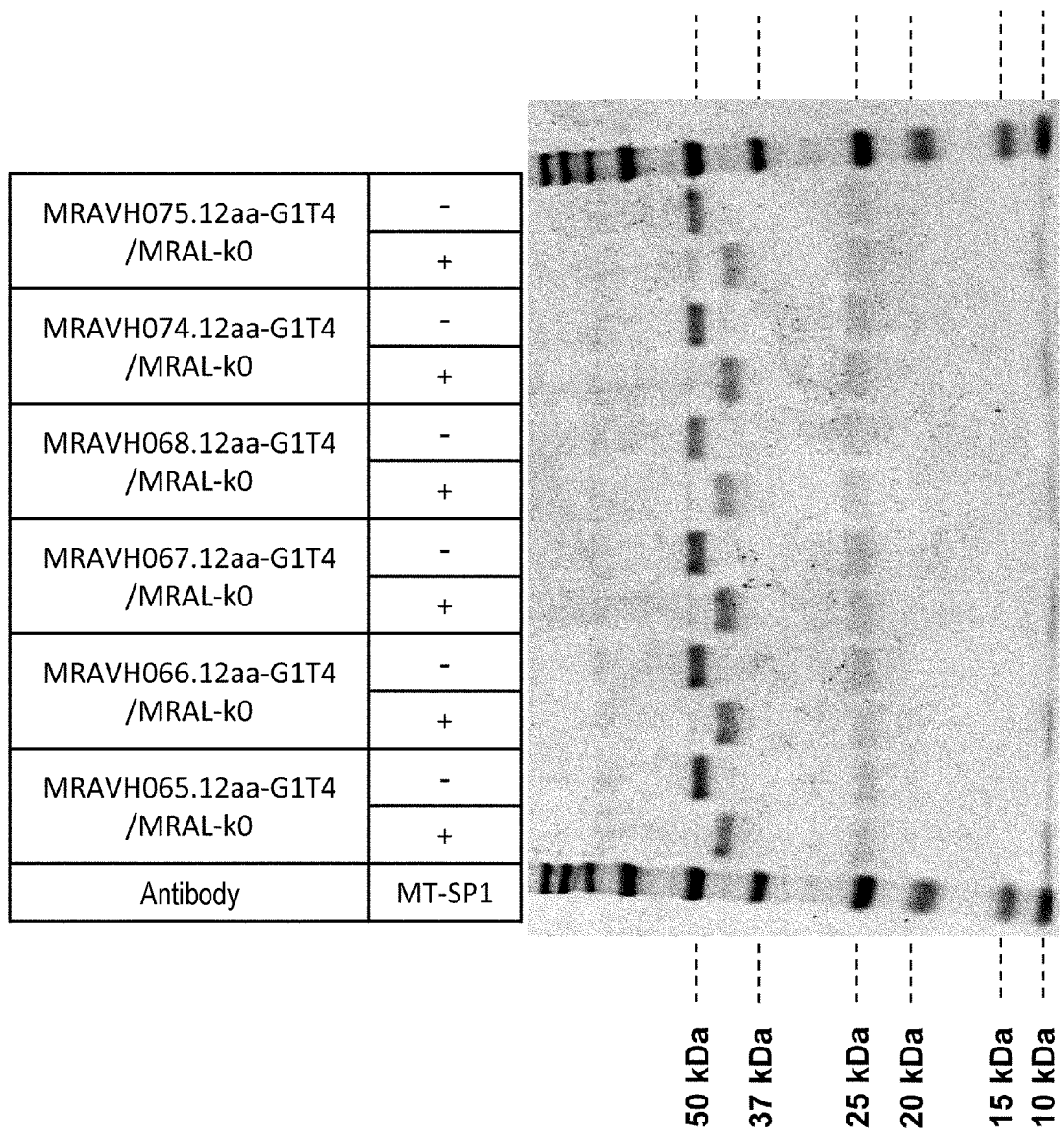

FIG. 22E is a diagram showing results of cleaving MRA antibody variants by protease.

Figure 22F:
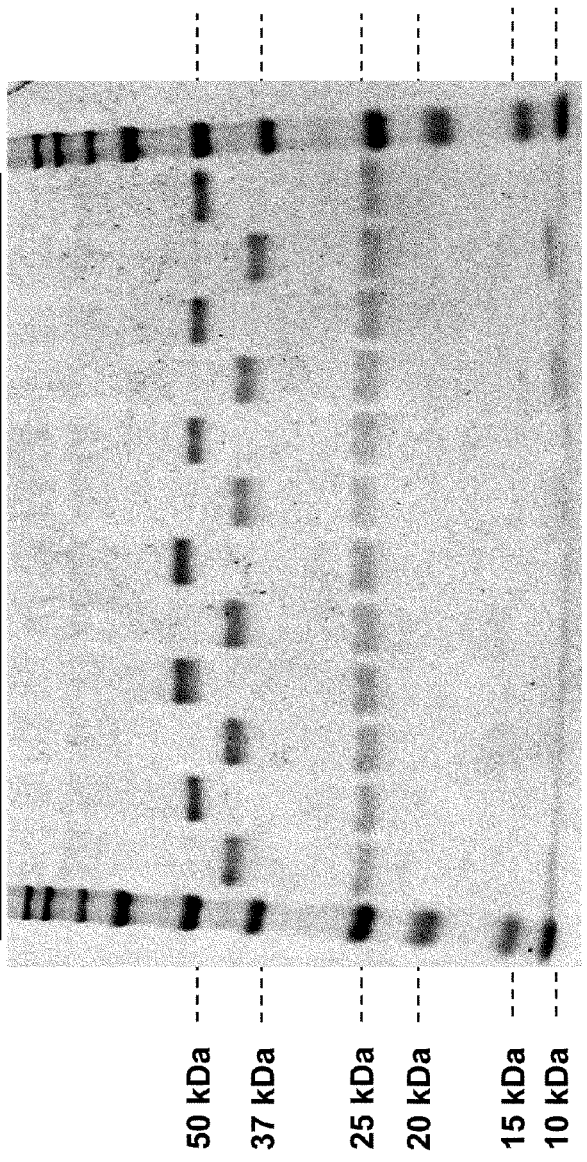

FIG. 22F is a diagram showing results of cleaving MRA antibody variants by protease.

Figure 22G:
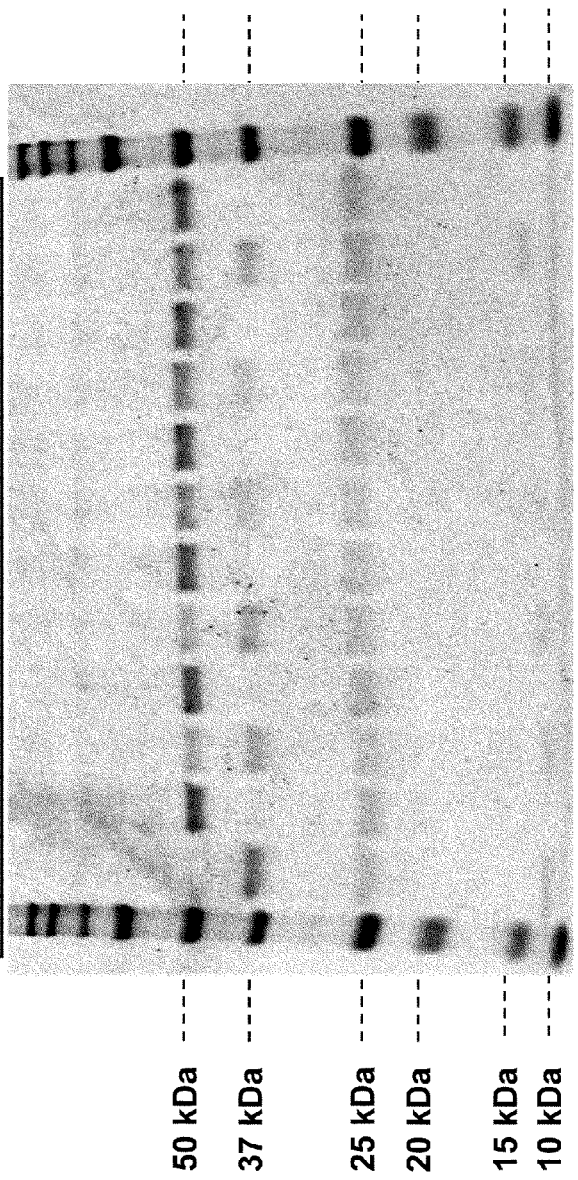

FIG. 22G is a diagram showing results of cleaving MRA antibody variants by protease.

Figure 22H:
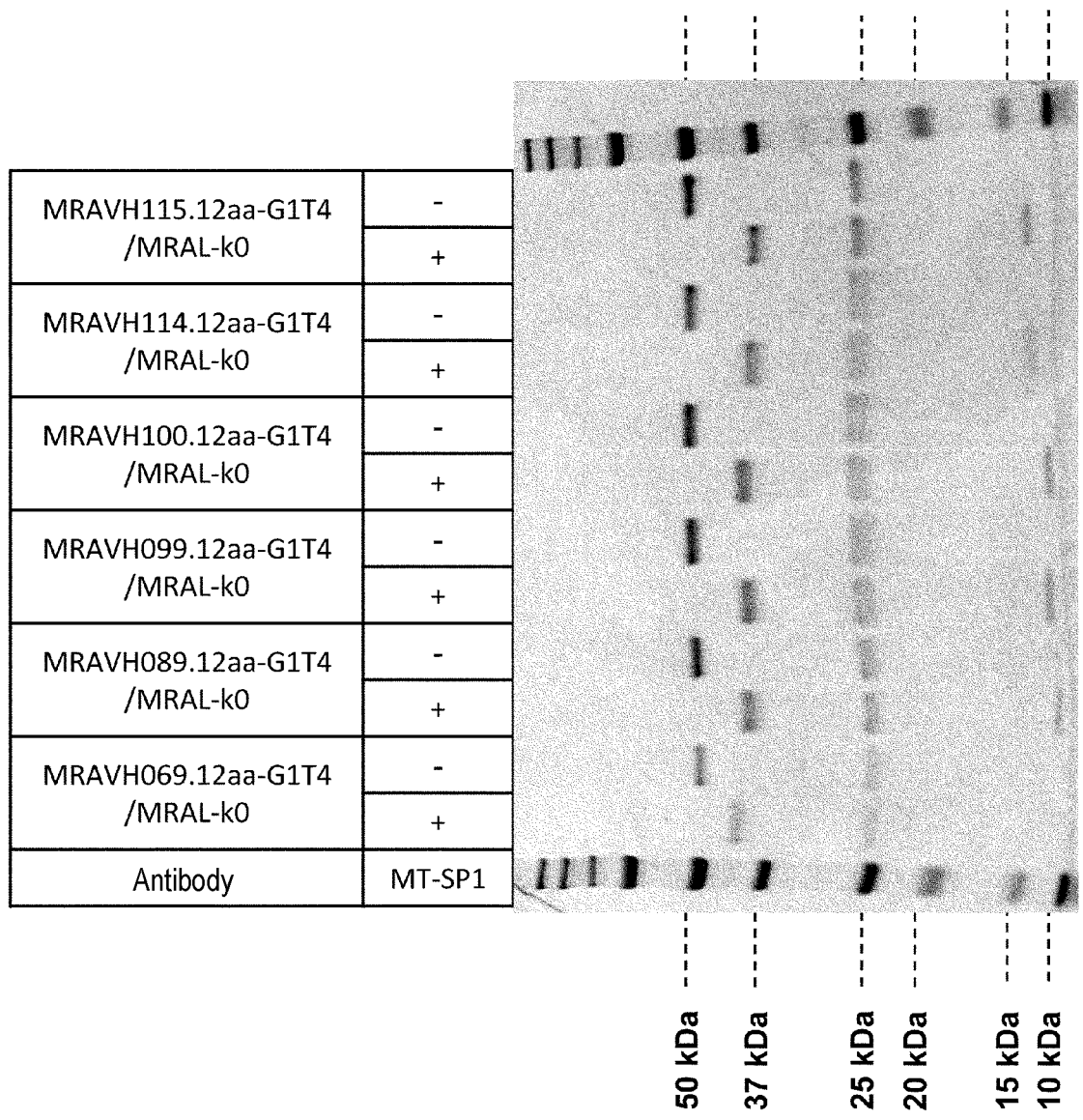

FIG. 22H is a diagram showing results of cleaving MRA antibody variants by protease.

Figure 22I:
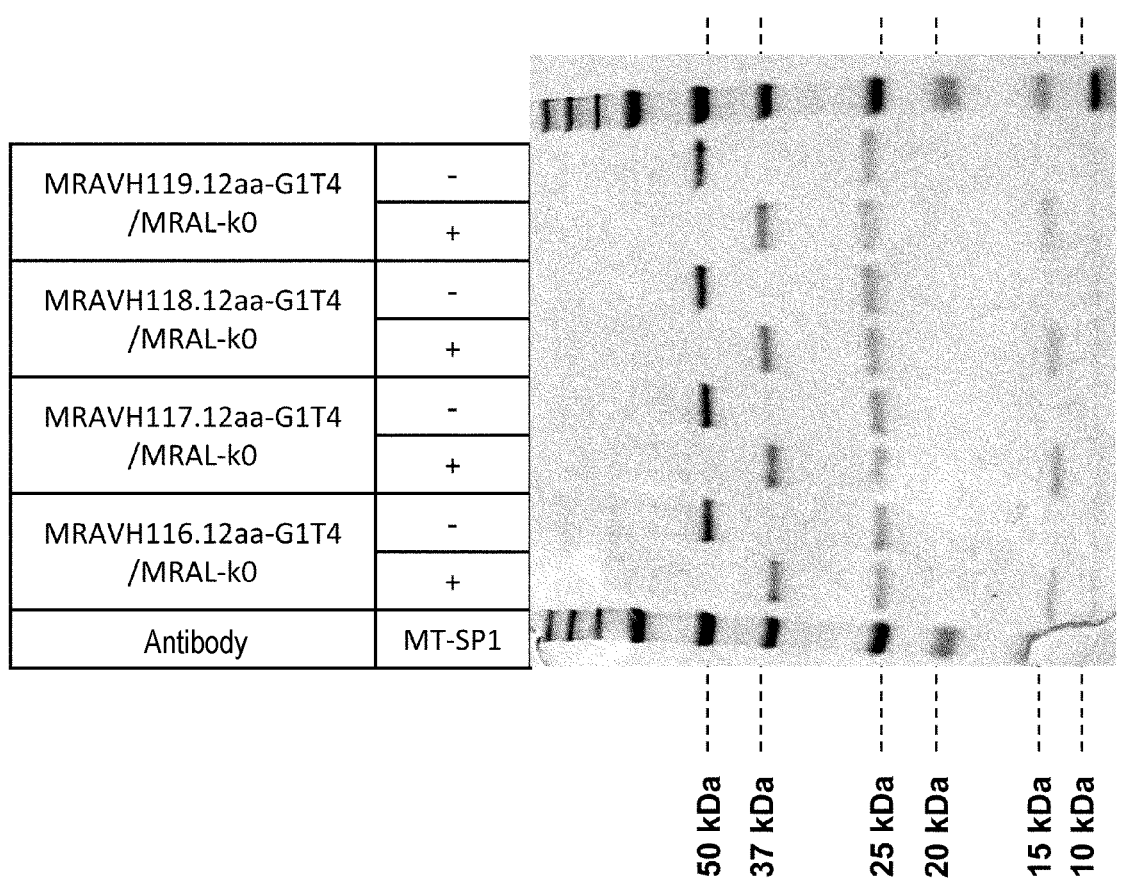

FIG. 22I is a diagram showing results of cleaving MRA antibody variants by protease.

Figure 23A:
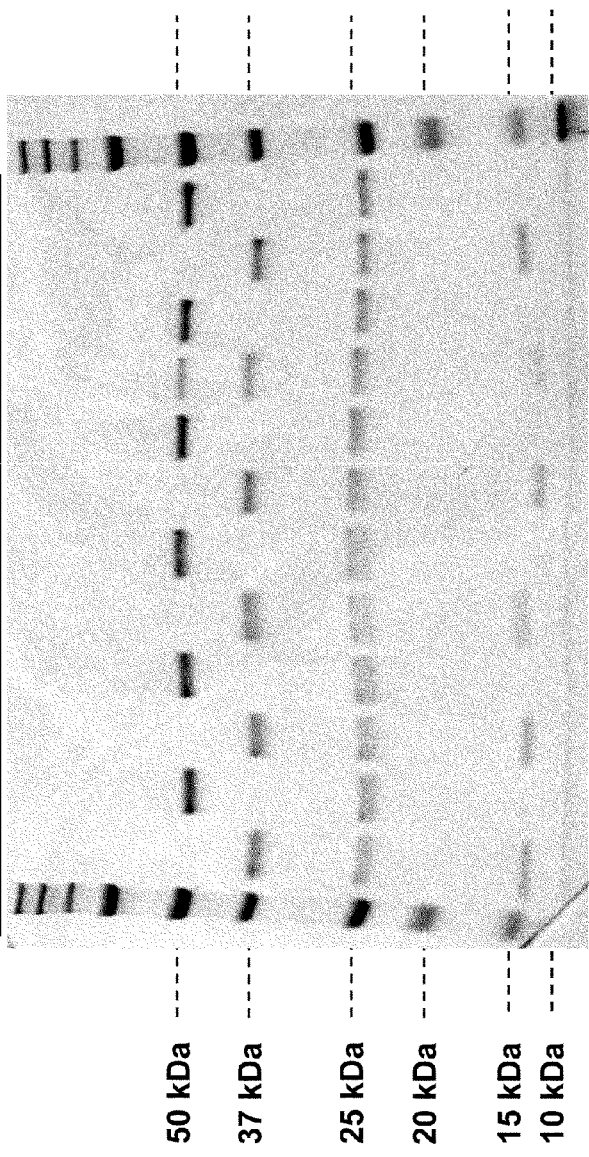

FIG. 23A is a diagram showing results of cleaving MRA antibody variants by protease.

Figure 23B:
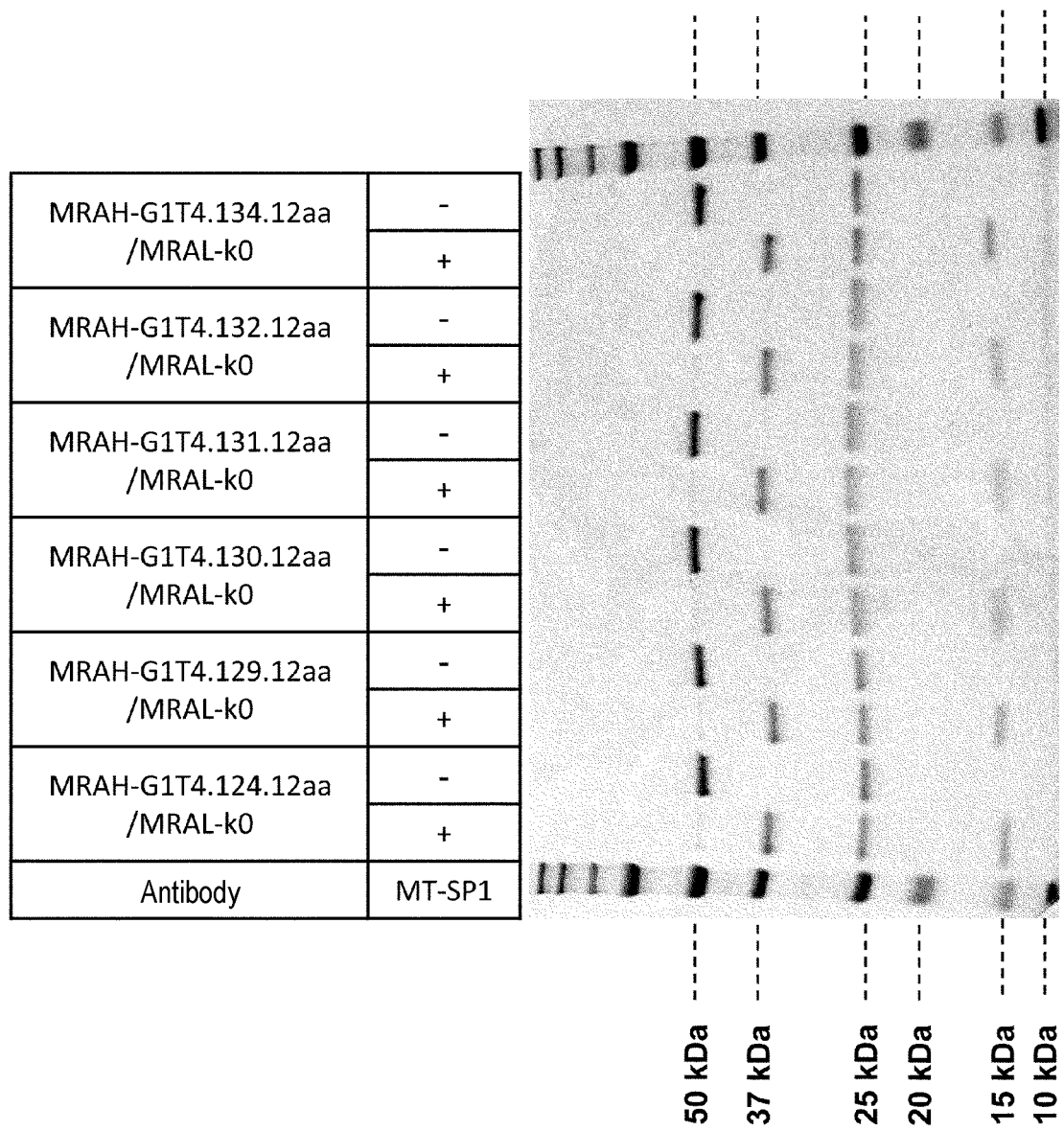

FIG. 23B is a diagram showing results of cleaving MRA antibody variants by protease.

Figure 23C:
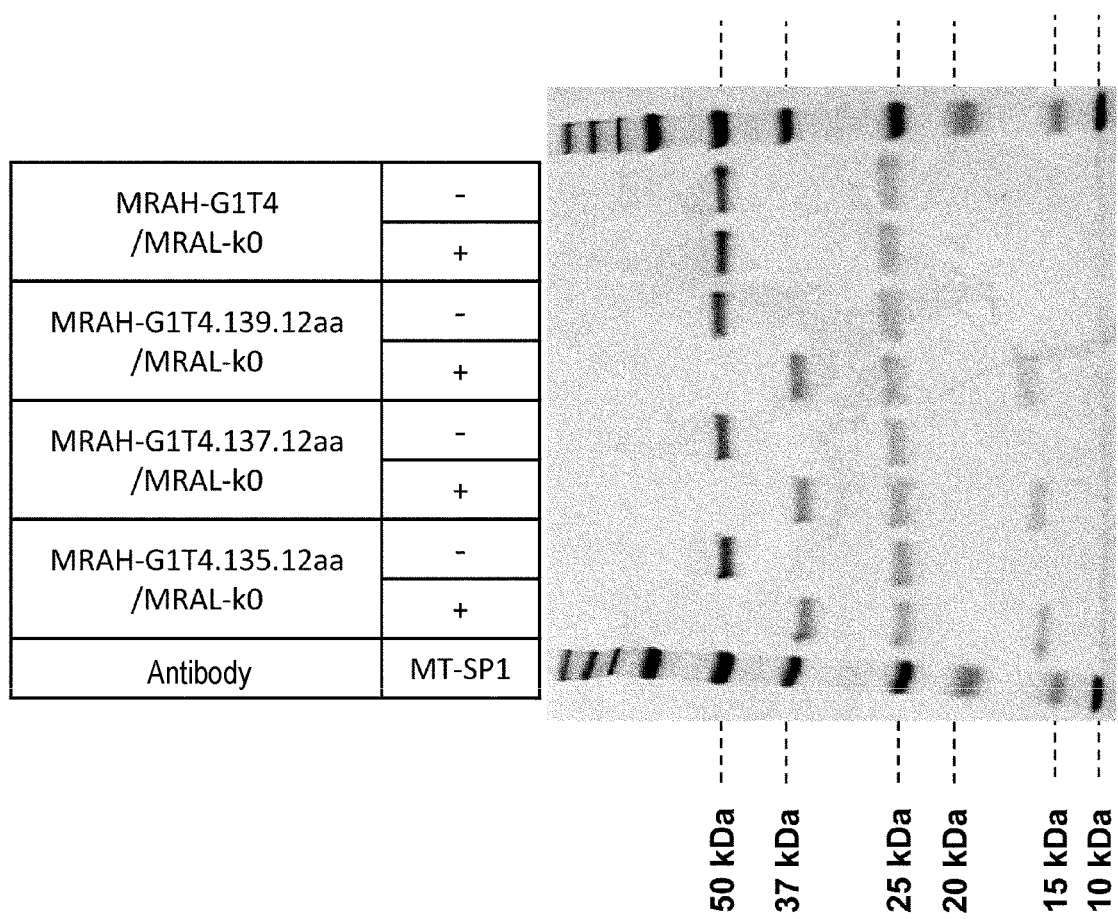

FIG. 23C is a diagram showing results of cleaving MRA antibody variants by protease.

Figure 24A:
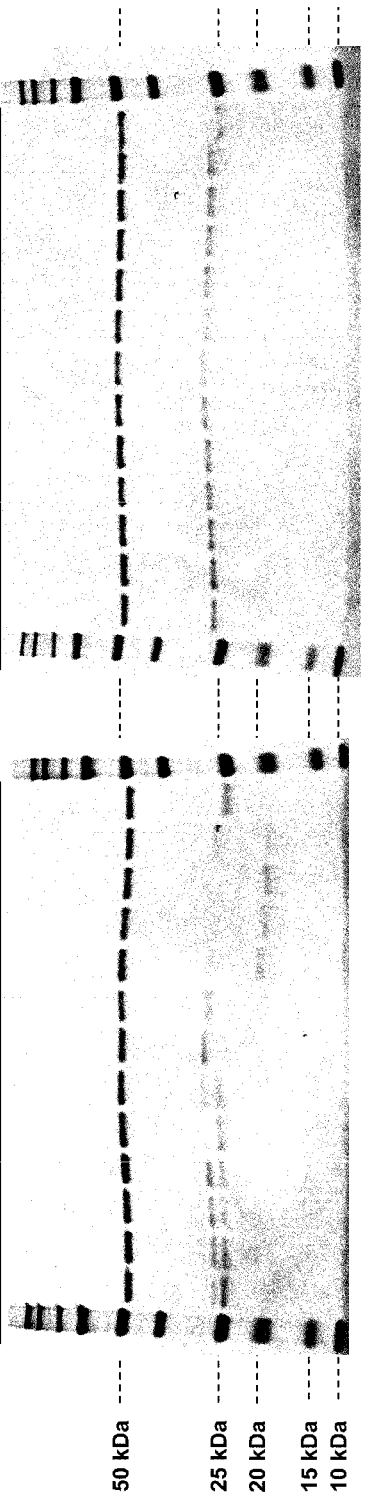

FIG. 24A is a diagram showing results of cleaving MRA antibody variants by protease.

Figure 24B:
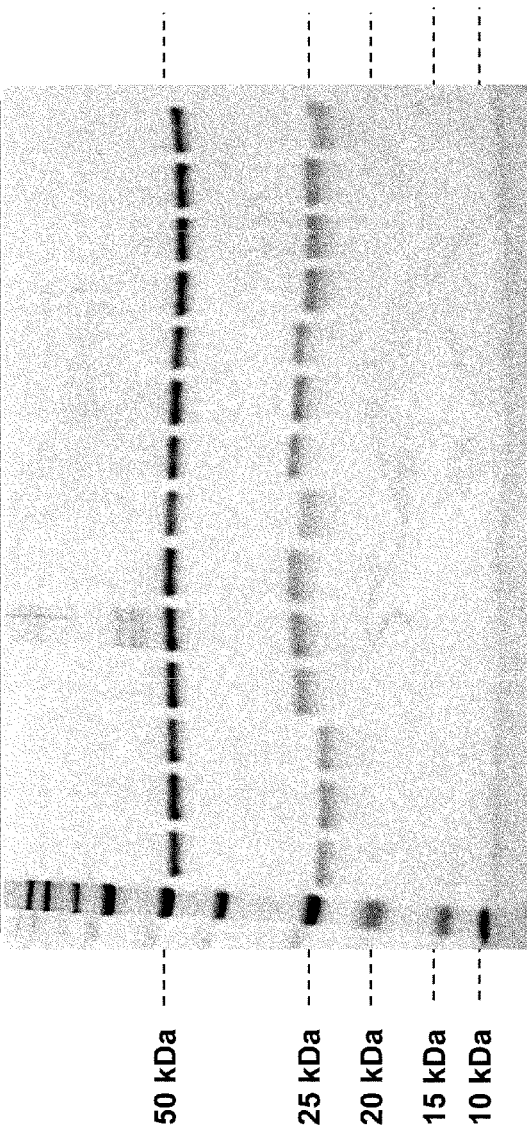

FIG. 24B is a diagram showing results of cleaving MRA antibody variants by protease.

Figure 24C:
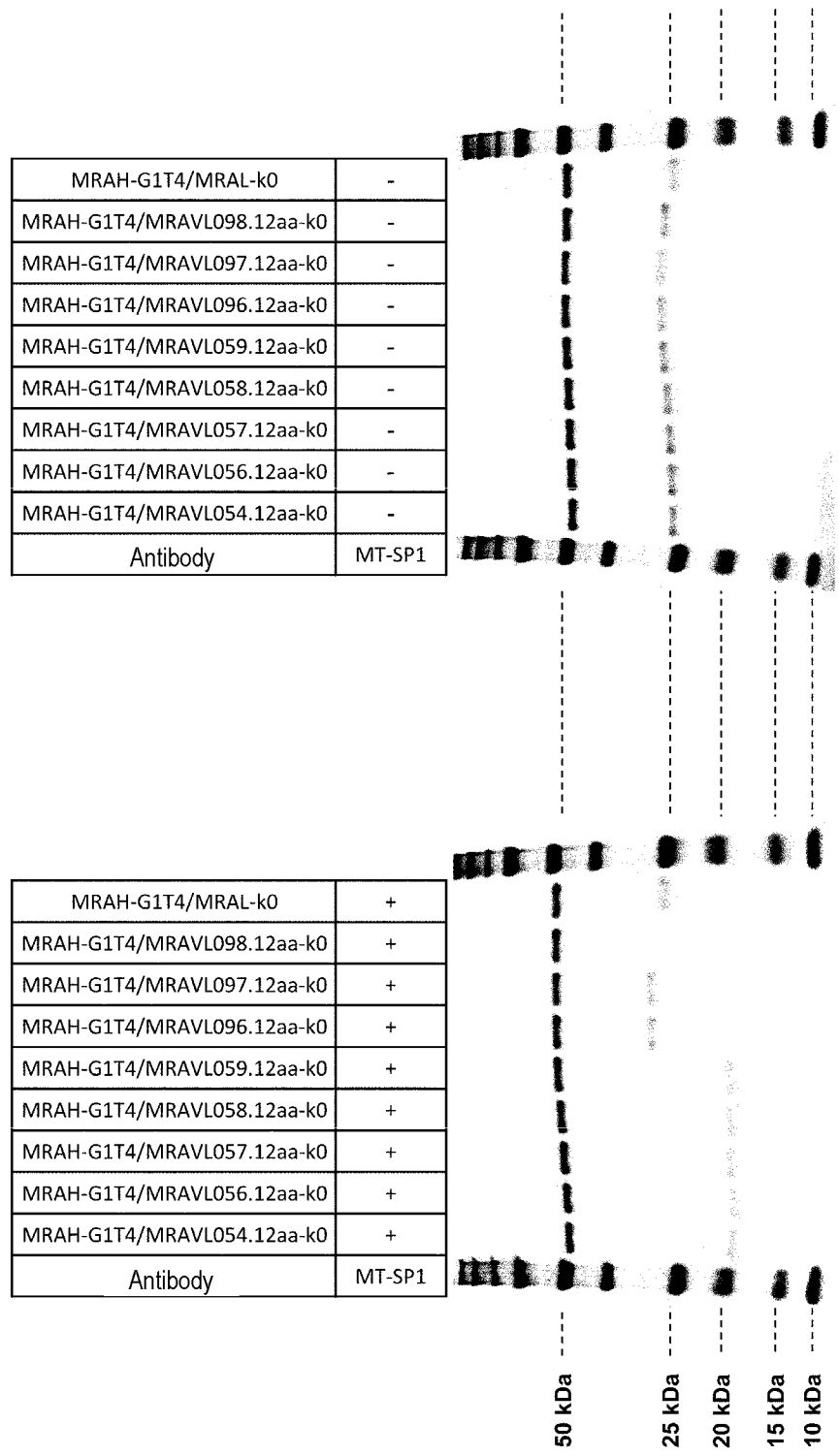

FIG. 24C is a diagram showing results of cleaving MRA antibody variants by protease.

Figure 24D:
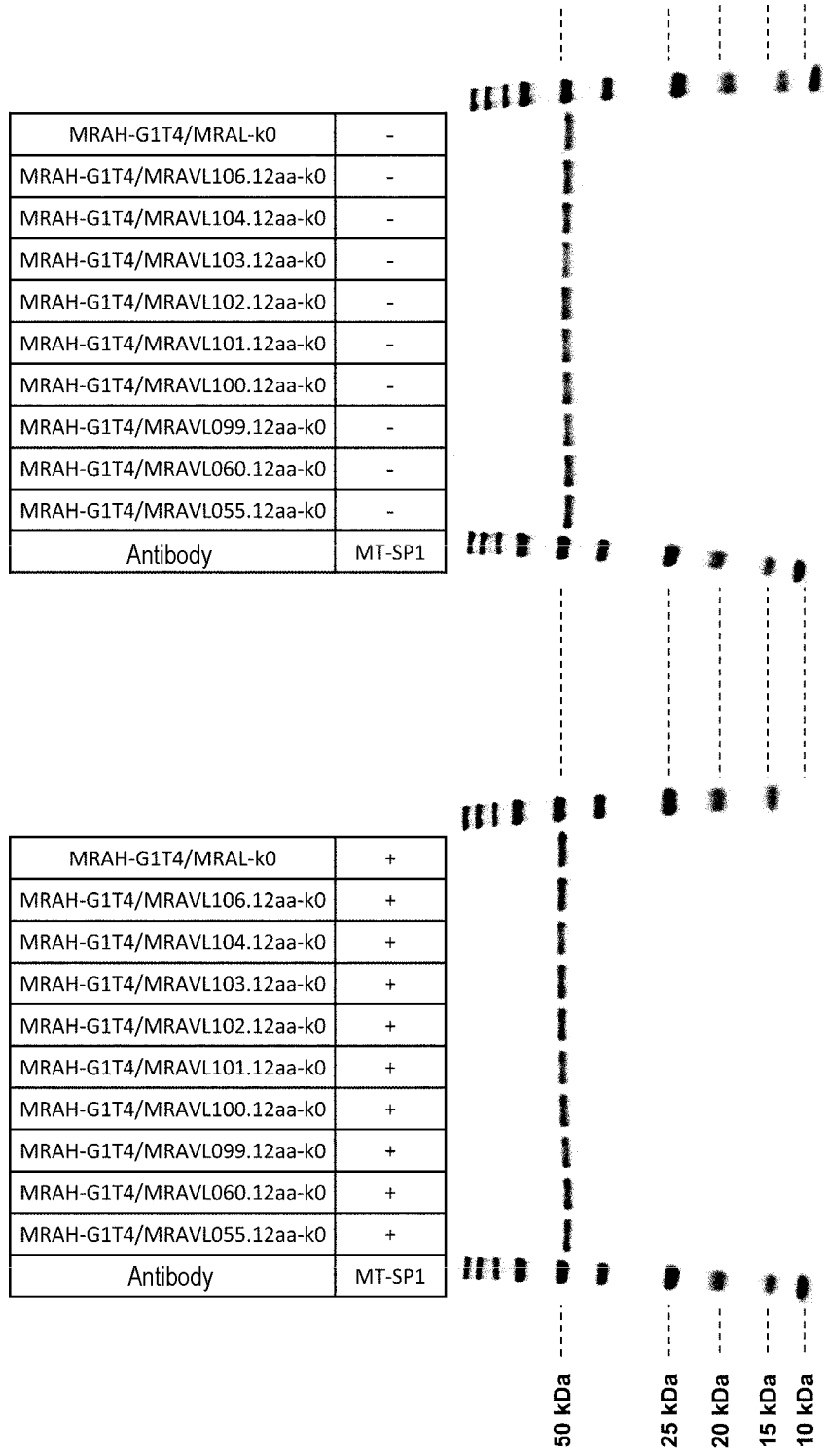

FIG. 24D is a diagram showing results of cleaving MRA antibody variants by protease.

Figure 24E:
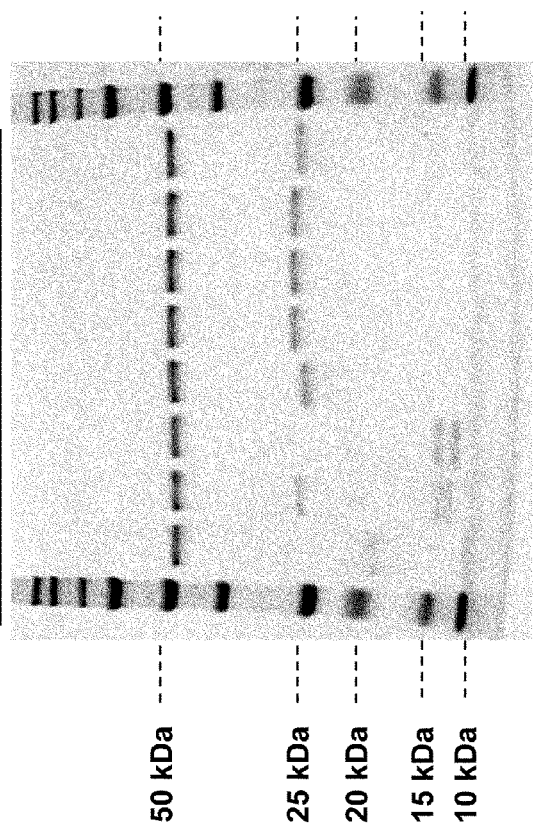

FIG. 24E is a diagram showing results of cleaving MRA antibody variants by protease.

Figure 25A:
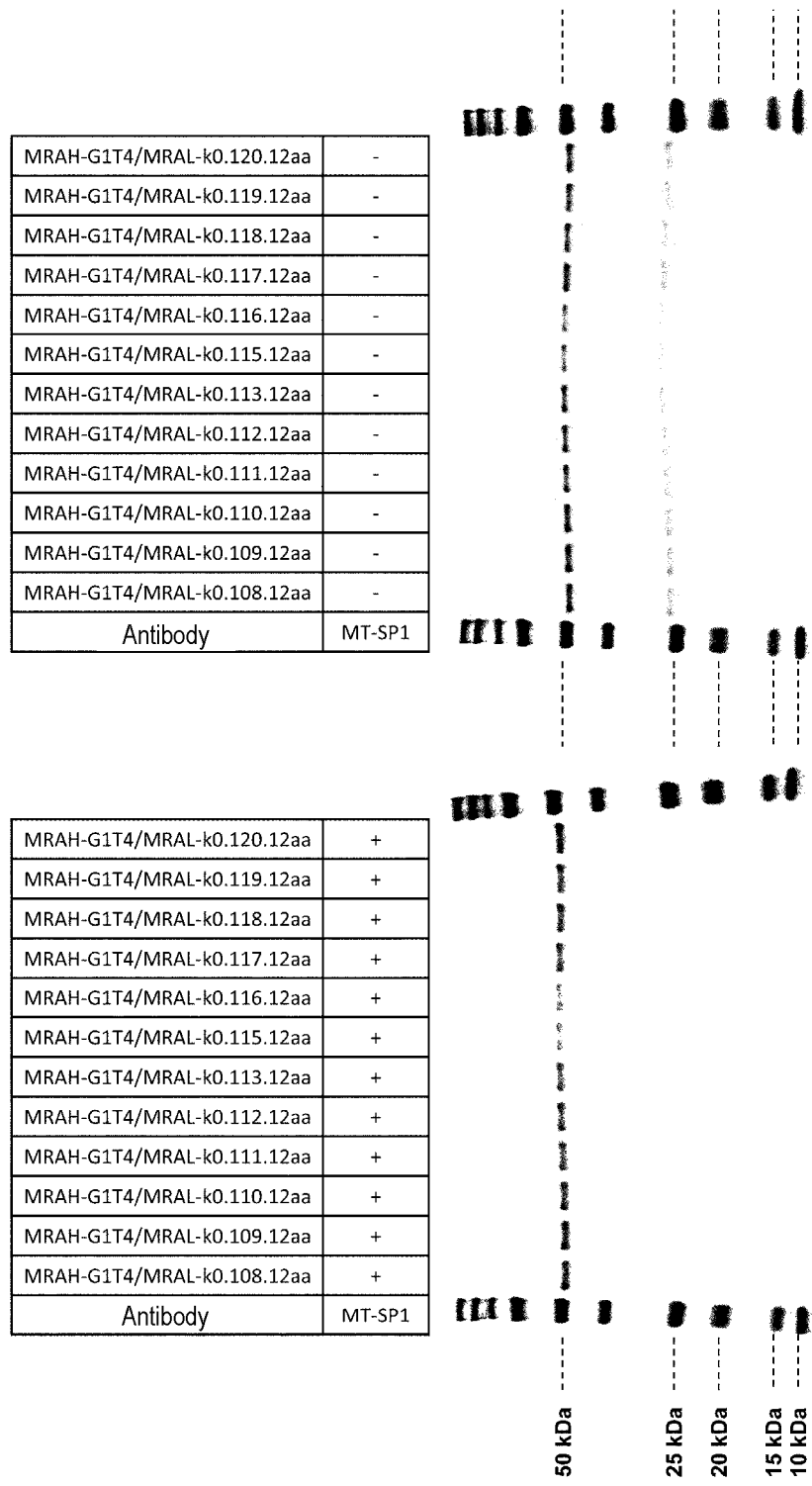

FIG. 25A is a diagram showing results of cleaving MRA antibody variants by protease.

Figure 25B:
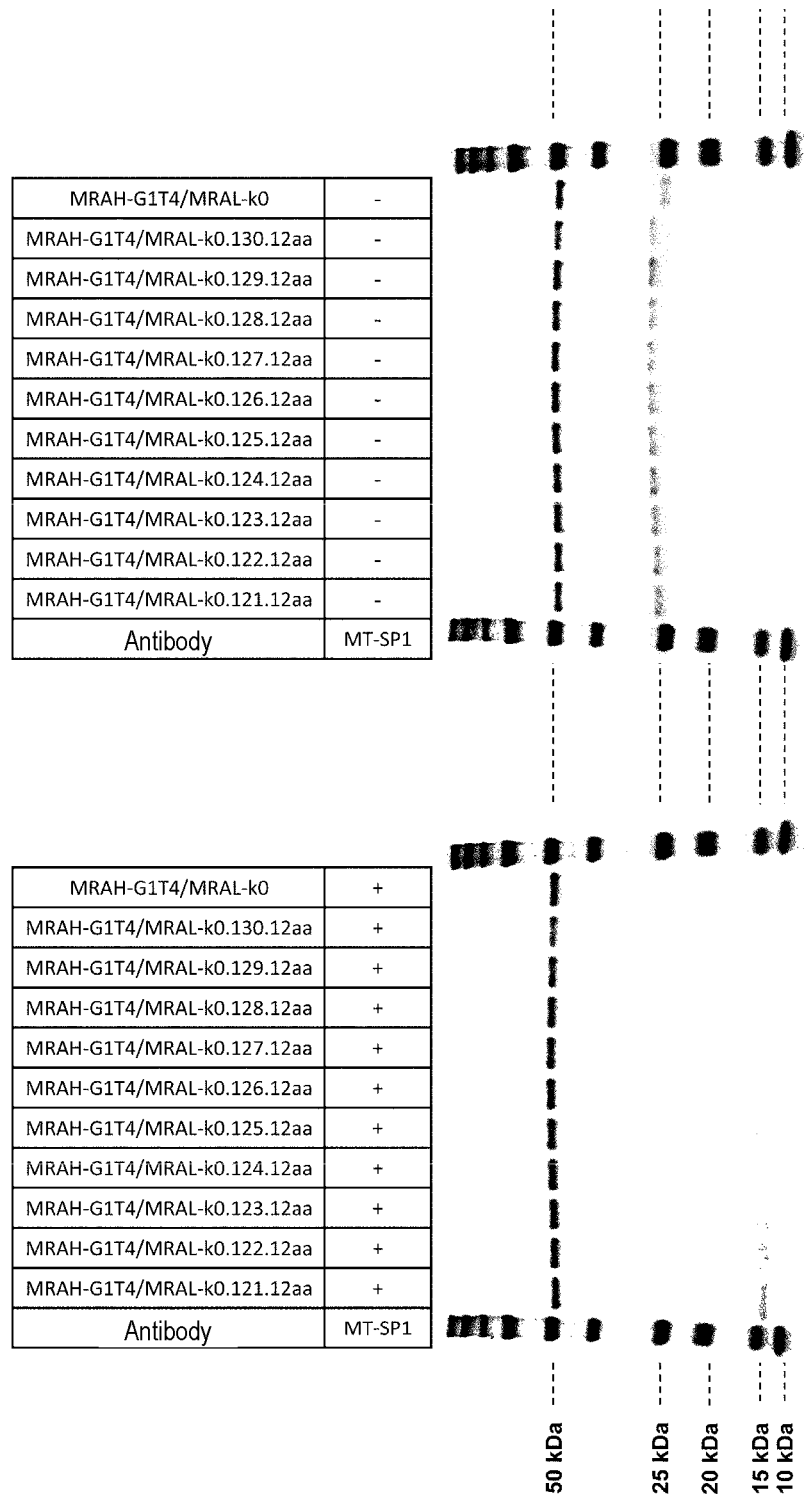

FIG. 25B is a diagram showing results of cleaving MRA antibody variants by protease.

Figure 26:
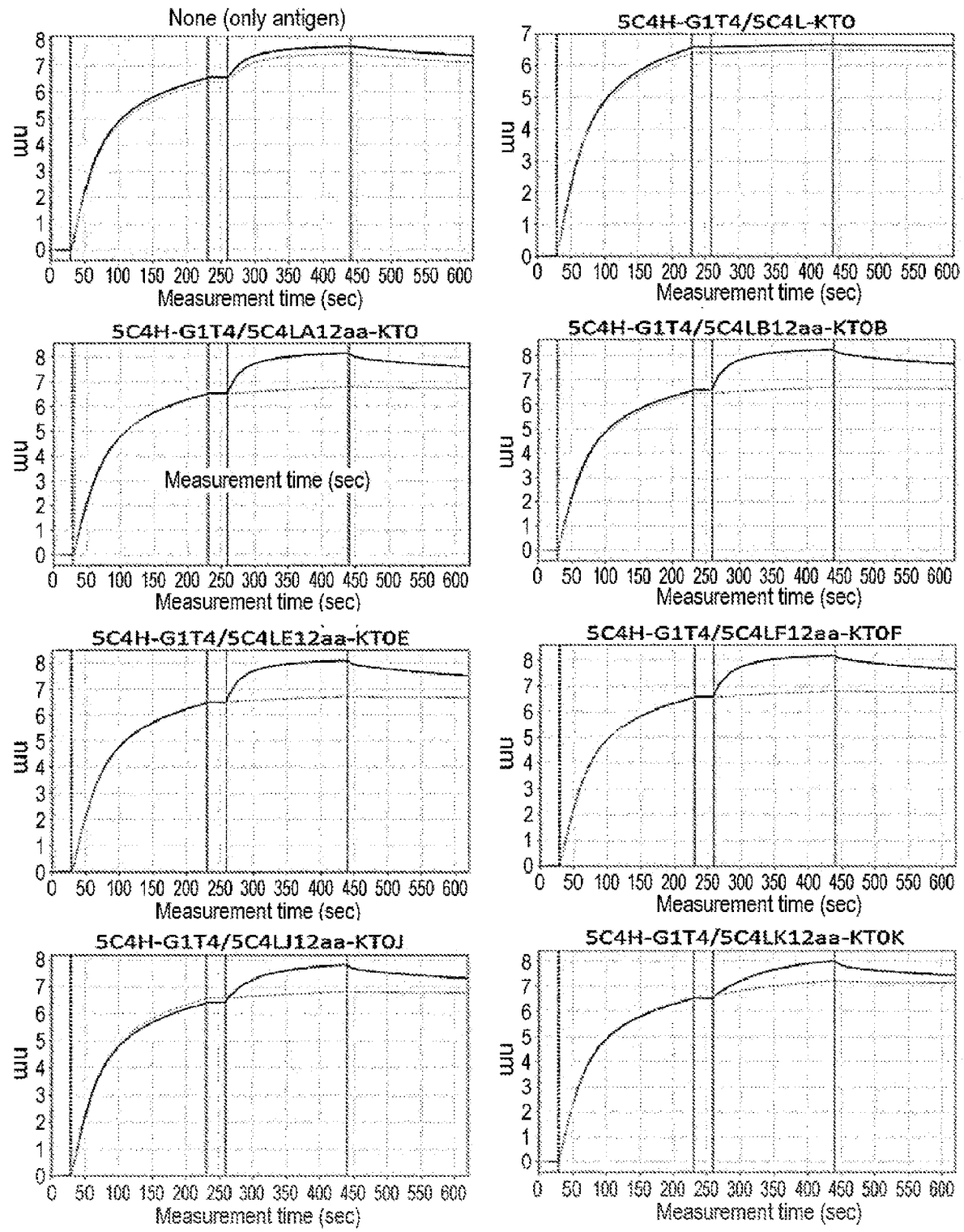

FIG. 26 is a diagram showing the comparison of real-time graphs showing the 5C4-bio binding of PD1 in samples for binding evaluation containing a protease-treated antibody or a protease-untreated antibody and the PD1. The heavy black lines depict the samples for binding evaluation containing the protease-treated antibody, and the thin gray lines depict the samples for binding evaluation containing the protease-untreated antibody. The X-axis depicts measurement time (sec), and the start of measurement was defined as 0 seconds. The Y-axis depicts binding. The name of each graph represents the antibody contained in the sample for evaluation. The graph "None (only antigen)" means that only the antigen was used as the sample for evaluation and was not mixed with an antibody.

FIG. 27 shows electrophoresis results of protease-treated antibodies and protease-untreated antibodies. Protease(+) lanes depict the protease-treated antibodies, and protease(−) lanes depict the protease-untreated antibodies.

Figure 28:
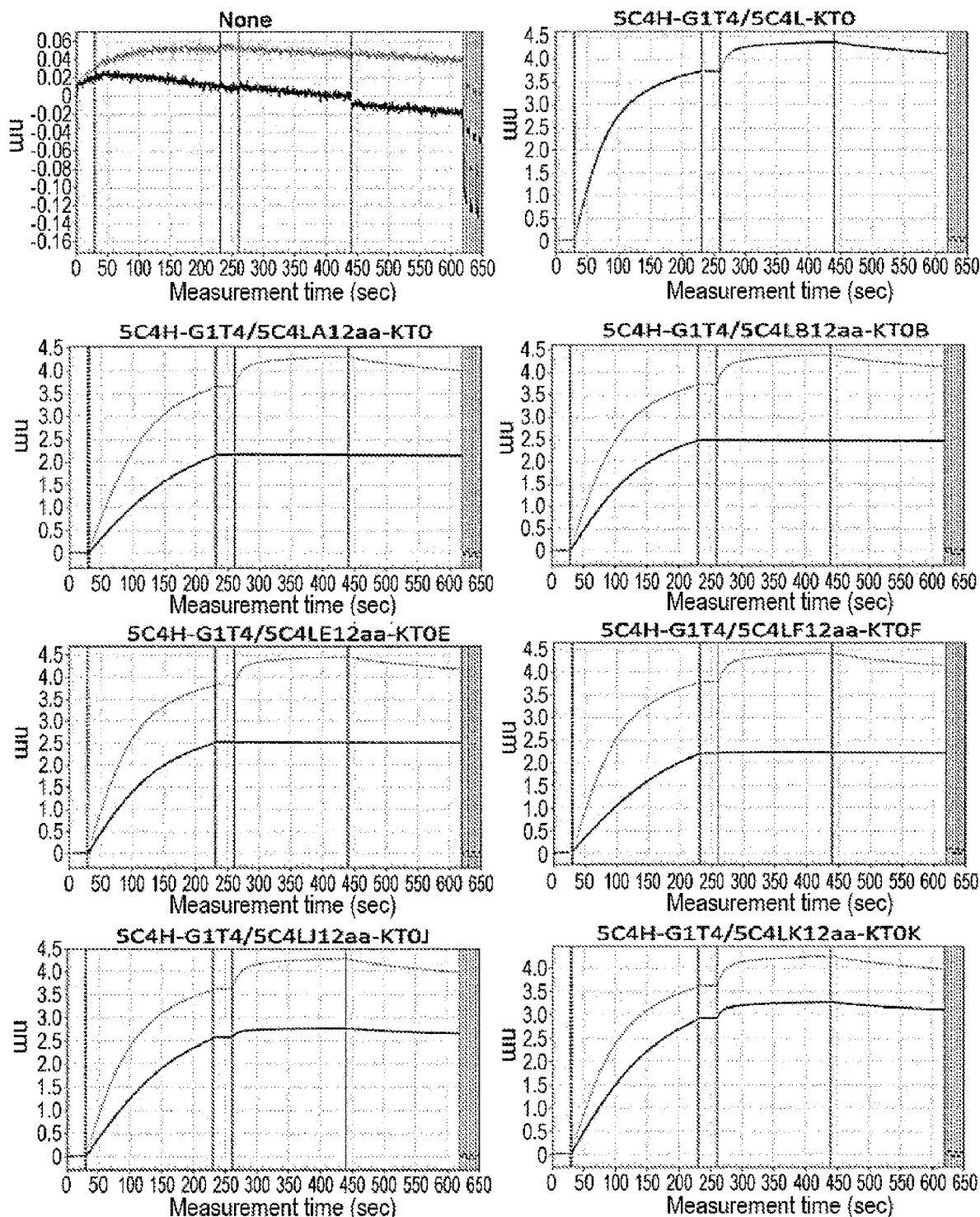

FIG. 28 is a diagram showing the comparison of real-time graphs showing the PD1 binding of protease-treated antibodies and protease-untreated antibodies. The heavy black lines depict the protease-treated antibodies, and the thin gray lines depict the protease-untreated antibodies. The X-axis depicts measurement time (sec), and the start of measurement was defined as 0 seconds. The Y-axis depicts binding. The name of each graph represents the antibody used. The graph "None" means that only a PBS buffer was used without the use of an antibody.

Figure 29:
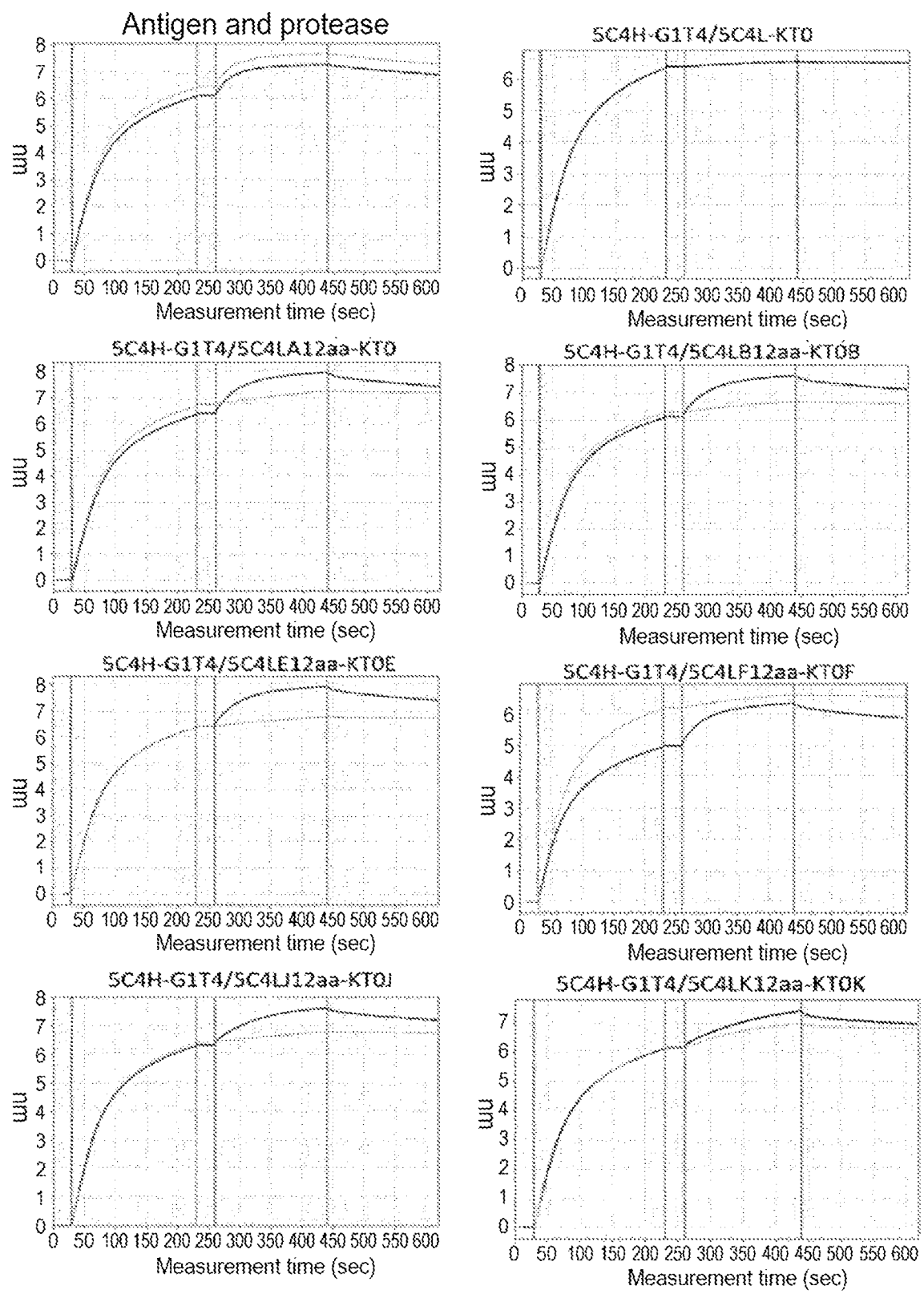

FIG. 29 is a diagram showing the comparison of real-time graphs showing the 5C4-bio binding of released PD1 present in samples treated with protease in the presence of PD1 and samples untreated with protease in the presence of PD1. The heavy black lines depict the protease-treated samples, and the thin gray lines depict the protease-untreated samples. The X-axis depicts measurement time (sec), and the start of measurement was defined as 0 seconds. The Y-axis depicts binding. The name of each graph represents the antibody contained in the sample. The graph "Antigen and protease" means that the sample contained only PD1 without containing an antibody.

Figure 30:
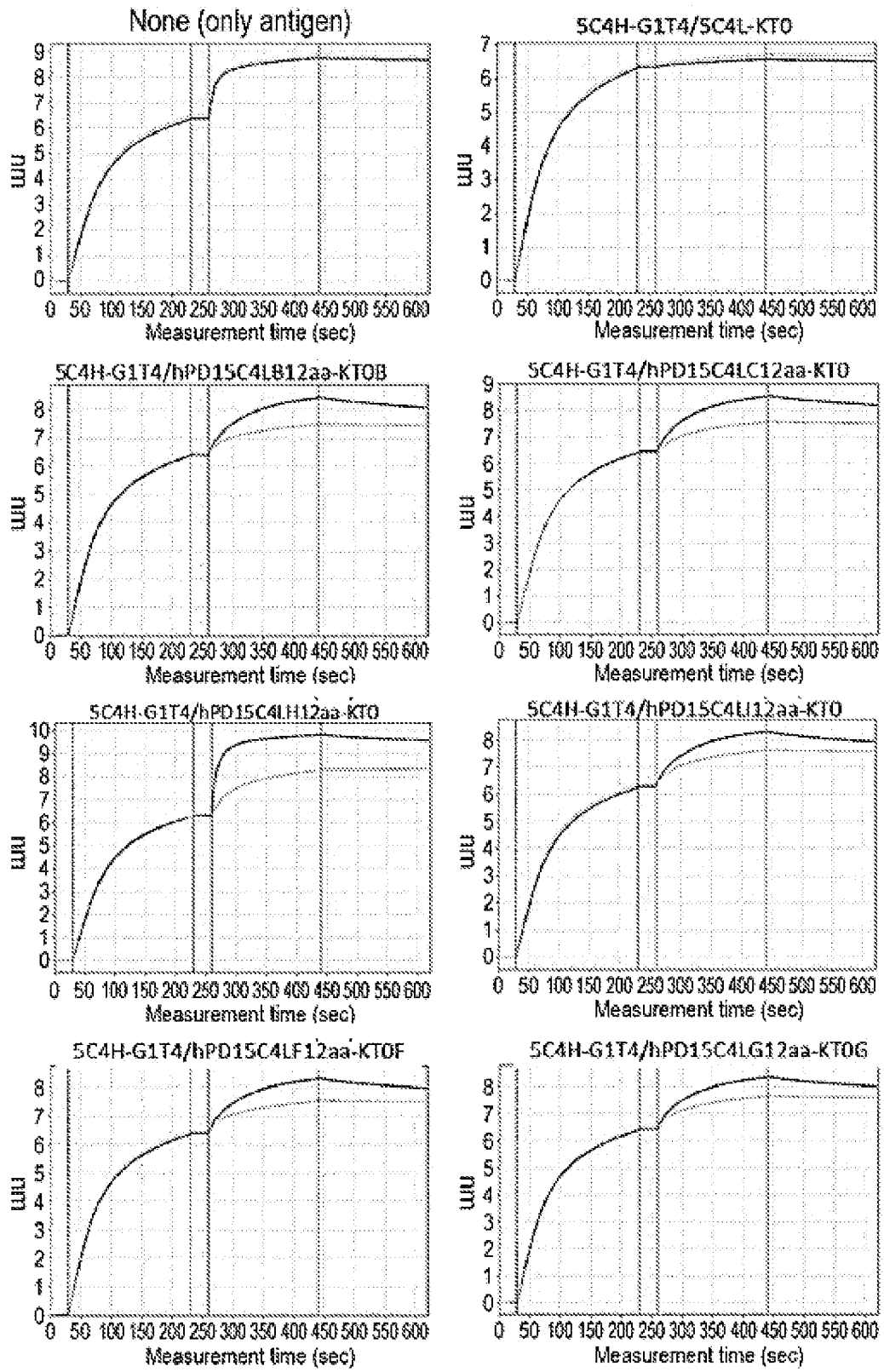
Figure 30:
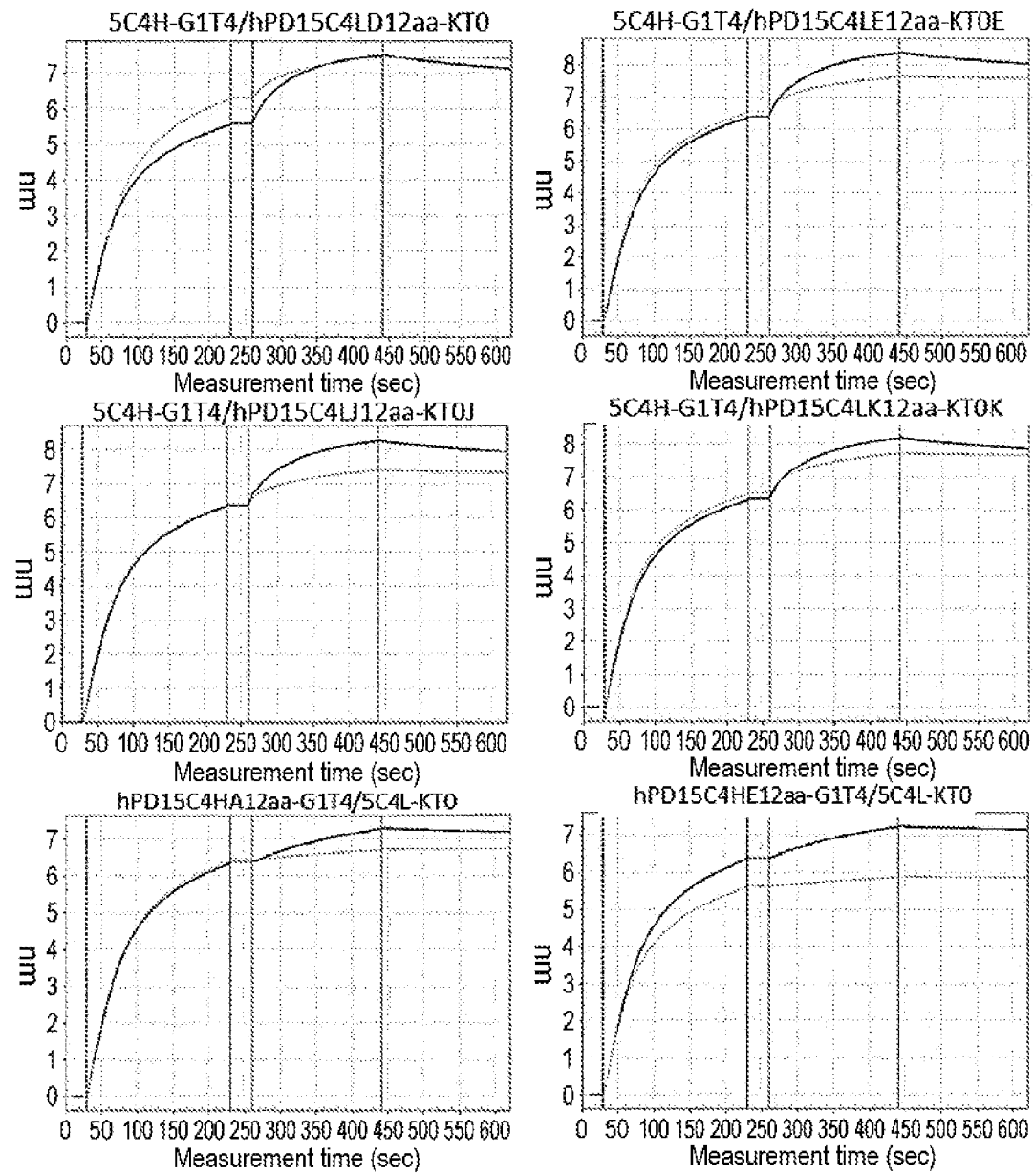

FIG. 30 is a diagram showing the comparison of real-time graphs showing the 5C4-bio binding of released PD1 present in protease-treated fusion protein and protease-untreated protein solutions. The heavy black lines depict the protease-treated samples, and the thin gray lines depict the protease-untreated samples. The X-axis depicts measurement time (sec), and the start of measurement was defined as 0 seconds. The Y-axis depicts binding. The name of each graph represents the antibody in the fusion protein. The graph "None (only antigen)" means that only the antigen PD1 was used as the sample for evaluation without the use of a fusion protein. The graph "5C4H-G1T4/5C4L-KTO" means that only a 5C4H-G1T4/5C4L-KTO antibody was used without the use of a fusion protein.

Figure 31:
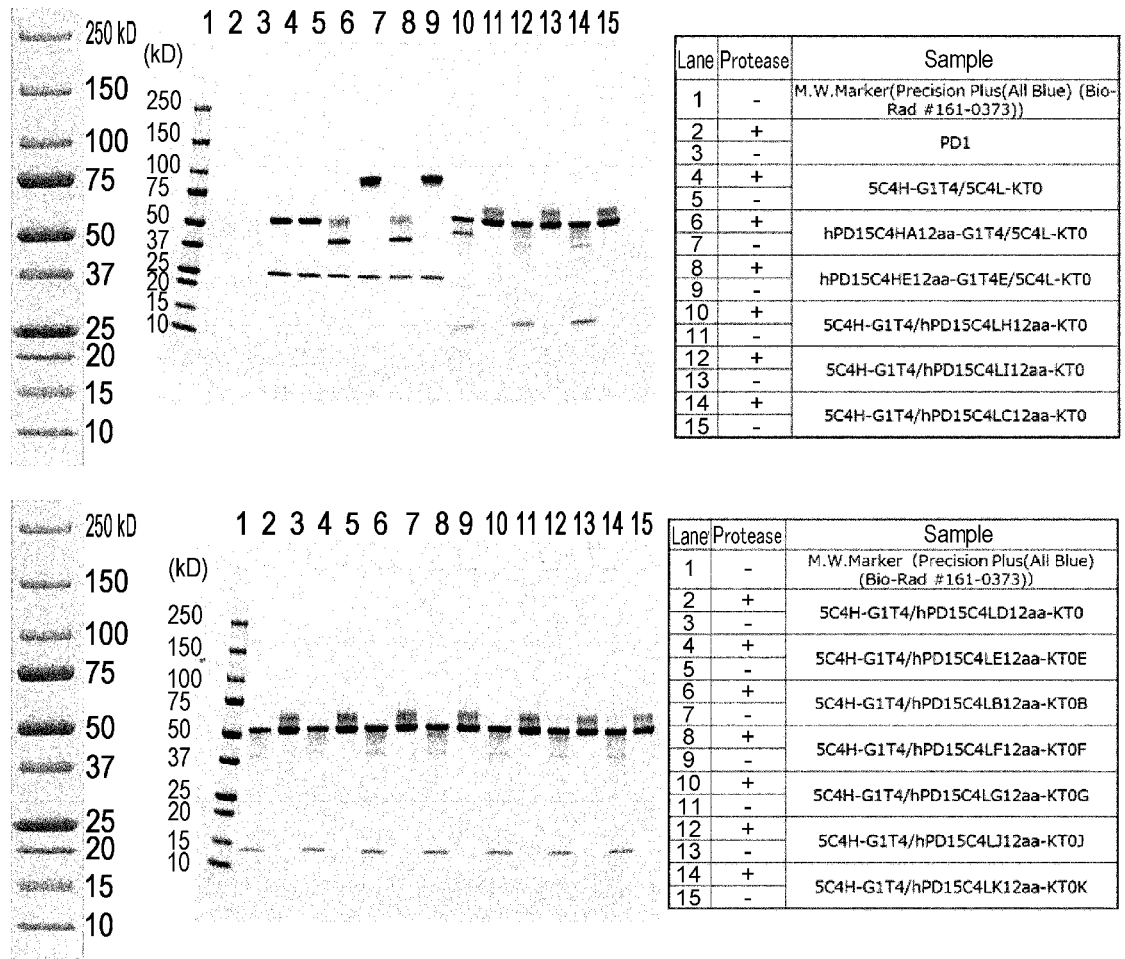

FIG. 31 shows electrophoresis results of antibody-PD1 fusion proteins treated with protease. Protease(+) lanes depict the protease-treated fusion proteins, and protease(−) lanes depict protease-untreated fusion proteins.

DESCRIPTION OF EMBODIMENTS

The polypeptide according to the present invention usually refers to a peptide having a length on the order of 4 amino acids or longer, and a protein. Also, the polypeptide according to the present invention is usually a polypeptide consisting of an artificially designed sequence, but is not limited thereto. For example, an organism-derived polypeptide may be used. Alternatively, the polypeptide according to the present invention may be any of a natural polypeptide, a synthetic polypeptide, a recombinant polypeptide, and the like. Furthermore, fragments of these polypeptides are also included in the polypeptide of the present invention.

In the present specification, each amino acid is indicated by one-letter code or three-letter code, or both, as represented by, for example, Ala/A, Leu/L, Arg/R, Lys/K, Asn/N, Met/M, Asp/D, Phe/F, Cys/C, Pro/P, Gln/Q, Ser/S, Glu/E, Thr/T, Gly/G, Trp/W, His/H, Tyr/Y, Ile/I, or Val/V.

For the alteration of an amino acid in the amino acid sequence of a polypeptide, a method known in the art such as site-directed mutagenesis (Kunkel et al. (Proc. Natl. Acad. Sci. USA (1985) 82, 488-492)) or overlap extension PCR can be appropriately adopted. A plurality of methods known in the art can also be adopted as alteration methods for substituting an amino acid by an amino acid other than a natural amino acid (Annu. Rev. Biophys. Biomol. Struct. (2006) 35, 225-249; and Proc. Natl. Acad. Sci. U.S.A. (2003) 100 (11), 6353-6357). For example, a tRNA-containing cell-free translation system (Clover Direct (Protein Express)) having a non-natural amino acid bound with amber suppressor tRNA complementary to UAG codon (amber codon), which is a stop codon, is also preferably used.

In the present specification, the term "and/or" used to represent amino acid alteration sites is meant to include every combination appropriately represented by "and" and "or". Specifically, for example, the phrase "amino acids at positions 37, 45, and/or 47 are substituted" includes the following variations of amino acid alteration:
(a) position 37, (b) position 45, (c) position 47, (d) positions 37 and 45, (e) positions 37 and 47, (f) positions 45 and 47, and (g) positions 37, 45 and 47.

In the present specification, expression in which the one-letter codes or three-letter-codes of amino acids before and after alteration are used previous and next to a number representing a particular position can be appropriately used for representing amino acid alteration. For example, an alteration F37V or Phe37Val used for substituting an amino acid contained in an antibody variable region represents the substitution of Phe at position 37 defined by the Kabat numbering by Val. Specifically, the number represents an amino acid position defined by the Kabat numbering; the one-letter code or three-letter code of the amino acid previous to the number represents the amino acid before the substitution; and the one-letter code or three-letter code of the amino acid next to the number represents the amino acid after the substitution. Likewise, an alteration P238A or Pro238Ala used for substituting an amino acid in a Fc region contained in an antibody constant region represents the substitution of Pro at position 238 defined by the EU numbering by Ala. Specifically, the number represents an amino acid position defined by the EU numbering; the one-letter code or three-letter code of the amino acid previous to the number represents the amino acid before the substitution; and the one-letter code or three-letter code of the amino acid next to the number represents the amino acid after the substitution.

The present invention relates to a ligand binding molecule having a cleavage site, wherein the ligand binding of the ligand binding molecule cleaved at the cleavage site is attenuated. The ligand binding molecule of the present invention is a polypeptide and refers to a molecule capable of binding to a ligand.

The ligand binding molecule of the present invention is a molecule capable of binding to a ligand, particularly, a molecule capable of binding to a ligand when uncleaved. In this context, the "binding" usually refers to binding through interaction based mainly on a noncovalent bond such as electrostatic force, van der Waals' force, or a hydrogen bond. Preferred examples of the ligand binding form of the ligand binding molecule of the present invention include, but are not limited to, antigen-antibody reaction through which an antigen binding region, an antigen binding molecule, an antibody, an antibody fragment, or the like binds to the antigen.

The phrase "capable of binding to a ligand" means that the ligand binding molecule is capable of binding to the ligand even if the ligand binding molecule and the ligand are different molecules and does not mean that the ligand binding molecule and the ligand are connected through a covalent bond. For example, the phrase "capable of binding to a ligand" does not mean that the ligand and the ligand binding molecule are connected through a covalent bond via a linker. Also, the phrase "ligand binding is attenuated" means that the capability of binding (binding capacity) described above is attenuated. For example, when the ligand and the ligand binding molecule are connected through a covalent bond via a linker, the cleavage of the linker does not mean that the ligand binding is attenuated. In the present invention, the ligand binding molecule may be connected with the ligand via a linker or the like as long as the ligand binding molecule is capable of binding to the ligand.

The ligand binding molecule of the present invention is limited only by binding to the ligand when uncleaved, and can be a molecule having any structure as long as the molecule used can bind to the ligand of interest when uncleaved. Examples of the ligand binding molecule include, but are not limited to, an antibody heavy chain variable region (VH), an antibody light chain variable region (VL), a single-domain antibody (sdAb), a module called A domain of approximately 35 amino acids contained in an in vivo cell membrane protein avimer (International Publication Nos. WO2004/044011 and WO2005/040229), adnectin containing a 10Fn3 domain serving as a protein binding domain derived from a glycoprotein fibronectin expressed on cell membranes (International Publication No. WO2002/032925), Affibody containing an IgG binding domain scaffold constituting a three-helix bundle composed of 58 amino acids of protein A (International Publication No. WO1995/001937), DARPins (designed ankyrin repeat proteins) which are molecular surface-exposed regions of ankyrin repeats (AR) each having a 33-amino acid residue structure folded into a subunit of a turn, two antiparallel helices, and a loop (International Publication No. WO2002/020565), anticalin having four loop regions connecting eight antiparallel strands bent toward the central axis in one end of a barrel structure highly conserved in lipocalin molecules such as neutrophil gelatinase-associated lipocalin (NGAL) (International Publication No. WO2003/029462), and a depressed region in the internal parallel sheet structure of a horseshoe-shaped fold composed of repeated leucine-rich-repeat (LRR) modules of an immunoglobulin structure-free variable lymphocyte receptor (VLR) as seen in the acquired immune systems of jawless vertebrates such as lamprey or hagfish (International Publication No. WO2008/016854).

In the present specification, the term "antibody" is used in the broadest sense and encompasses various antibody structures including, but are not limited to, a monoclonal antibody, a polyclonal antibody, a multispecific antibody (e.g., a bispecific antibody), and an antibody fragment as long as the antibody exhibits the desired antigen binding activity.

A method for preparing an antibody having desired binding activity is known to those skilled in the art. Hereinafter, a method for preparing an antibody binding to IL-6R (anti-IL-6R antibody) will be given as an example. Antibodies binding to antigens other than IL-6R can also be appropriately prepared according to the example given below.

The anti-IL-6R antibody can be obtained as a polyclonal or monoclonal antibody by use of an approach known in the art. A mammal-derived monoclonal antibody can be preferably prepared as the anti-IL-6R antibody. The mammal-derived monoclonal antibody includes, for example, those produced by hybridomas and those produced by host cells transformed with an expression vector containing an antibody gene by a genetic engineering approach. The antibody described in the present application includes a "humanized antibody" and a "chimeric antibody".

The monoclonal antibody-producing hybridomas can be prepared by use of a technique known in the art, for example, as follows: mammals are immunized with IL-6R protein used as a sensitizing antigen according to a usual immunization method. Immunocytes thus obtained are fused with parental cells known in the art by a usual cell fusion method. Next, cells producing a monoclonal antibody can be screened for by a usual screening method to select hybridomas producing the anti-IL-6R antibody.

Specifically, the monoclonal antibody is prepared, for example, as follows: first, the IL-6R gene can be expressed to obtain the IL-6R protein which is used as a sensitizing antigen for antibody obtainment. Specifically, a gene sequence encoding IL-6R is inserted into an expression vector known in the art, with which appropriate host cells are then transformed. The desired human IL-6R protein is purified from the host cells or from a culture supernatant thereof by a method known in the art. In order to obtain soluble IL-6R from the culture supernatant, for example, soluble IL-6R as described by Mullberg et al. (J. Immunol. (1994) 152 (10), 4958-4968) is expressed. Alternatively, purified natural IL-6R protein can also be used as a sensitizing antigen.

The purified IL-6R protein can be used as the sensitizing antigen for use in the immunization of mammals. A partial peptide of IL-6R can also be used as the sensitizing antigen. This partial peptide may be obtained by chemical synthesis from the amino acid sequence of human IL-6R. Alternatively, the partial peptide may be obtained by the integration of a portion of the IL-6R gene to an expression vector followed by its expression. Furthermore, the partial peptide can also be obtained by the degradation of the IL-6R protein with a proteolytic enzyme. The region and size of the IL-6R peptide for use as such a partial peptide are not particularly limited by specific embodiments. The number of amino acids constituting the peptide as the sensitizing antigen is preferably at least 5 or more, for example, 6 or more or 7 or more. More specifically, a peptide of 8 to 50, preferably 10 to 30 residues can be used as the sensitizing antigen.

A different polypeptide can be used as the sensitizing antigen. For example, an antibody Fc fragment or a peptide tag can be preferably used for producing the fusion protein for use as the sensitizing antigen. A vector for the expression of the fusion protein can be prepared by fusing in frame genes encoding two or more types of the desired polypeptide fragments, and inserting the fusion gene into an expression vector as described above. The method for preparing the fusion protein is described in Molecular Cloning 2nd ed. (Sambrook, J. et al., Molecular Cloning 2nd ed., 9.47-9.58 (1989), Cold Spring Harbor Lab. Press). The method for obtaining IL-6R for use as the sensitizing antigen and the immunization method using this sensitizing antigen are also specifically described in WO2003/000883, WO2004/022754, WO2006/006693, etc.

The mammals to be immunized with the sensitizing antigen are not limited to particular animals. The mammals to be immunized are preferably selected in consideration of compatibility with the parental cells for use in cell fusion. In general, rodents (e.g., mice, rats, and hamsters), rabbits, monkeys, or the like are preferably used.

These animals are immunized with the sensitizing antigen according to a method known in the art. For example, a general immunization method involves administering the sensitizing antigen to the mammals by intraperitoneal or subcutaneous injection. Specifically, the sensitizing antigen diluted with PBS (phosphate-buffered saline), physiological saline, or the like at an appropriate dilution ratio is mixed, if desired, with a usual adjuvant, for example, a Freund's complete adjuvant and emulsified. Then, the resulting sensitizing antigen is administered to the mammals several times at 4- to 21-day intervals. Also, an appropriate carrier can be used in the immunization with the sensitizing antigen. Particularly, in the case of using a partial peptide having a small molecular weight as the sensitizing antigen, immunization with the sensitizing antigen peptide bound with a carrier protein such as albumin or keyhole limpet hemocyanin may be desirable in some cases.

Alternatively, the hybridomas producing the desired antibody can also be prepared as described below by use of DNA immunization. The DNA immunization is an immunization method which involves immunostimulating immunized animals by expressing in vivo the sensitizing antigen in the immunized animals given vector DNA that has been constructed in a form capable of expressing the gene encoding the antigenic protein in the immunized animals. The DNA immunization can be expected to be superior to the general immunization method using the administration of the protein antigen to animals to be immunized as follows:

the DNA immunization can provide immunostimulation with the structure of a membrane protein (e.g., IL-6R) maintained; and the DNA immunization eliminates the need of purifying the immunizing antigen.

In order to obtain the monoclonal antibody of the present invention by the DNA immunization, first, DNA for IL-6R protein expression is administered to the animals to be immunized. The DNA encoding IL-6R can be synthesized by a method known in the art such as PCR. The obtained DNA is inserted into an appropriate expression vector, which is then administered to the animals to be immunized. For example, a commercially available expression vector such as pcDNA3.1 can be preferably used as the expression vector. A method generally used can be used as a method for administering the vector to the organisms. For example, gold particles with the expression vector adsorbed thereon are transfected into the cells of animal individuals to be immunized using a gene gun to thereby perform the DNA immunization. Furthermore, the antibody recognizing IL-6R can also be prepared by use of a method described in International Publication No. WO 2003/104453.

A rise in the titer of the antibody binding to IL-6R is confirmed in the serum of the mammals thus immunized. Then, immunocytes are collected from the mammals and subjected to cell fusion. Particularly, spleen cells can be used as preferred immunocytes.

Mammalian myeloma cells are used in the cell fusion with the immunocytes. The myeloma cells preferably have an appropriate selection marker for screening. The selection marker refers to a trait that can survive (or cannot survive) under particular culture conditions. For example, hypoxanthine-guanine phosphoribosyltransferase deficiency (hereinafter, referred to as HGPRT deficiency) or thymidine kinase deficiency (hereinafter, referred to as TK deficiency) is known in the art as the selection marker. Cells having the HGPRT or TK deficiency are sensitive to hypoxanthine-aminopterin-thymidine (hereinafter, referred to as HAT-sensitive). The HAT-sensitive cells are killed in a HAT selective medium because the cells fail to synthesize DNA. By contrast, these cells, when fused with normal cells, become able to grow even in the HAT selective medium because the fused cells can continue DNA synthesis through the use of the salvage pathway of the normal cells.

The cells having the HGPRT or TK deficiency can be selected in a medium containing 6-thioguanine or 8-azaguanine (hereinafter, abbreviated to 8AG) for the HGPRT deficiency or 5'-bromodeoxyuridine for the TK deficiency. The normal cells are killed by incorporating these pyrimidine analogs into their DNAs. By contrast, the cells deficient in these enzymes can survive in the selective medium because the cells cannot incorporate the pyrimidine analogs therein. In addition, a selection marker called G418 resistance confers resistance to a 2-deoxystreptamine antibiotic (gentamicin analog) through a neomycin resistance gene. Various myeloma cells suitable for cell fusion are known in the art.

For example, P3 (P3x63Ag8.653) (J. Immunol. (1979) 123 (4), 1548-1550), P3x63Ag8U.1 (Current Topics in Microbiology and Immunology (1978) 81, 1-7), NS-1 (C. Eur. J. Immunol. (1976) 6 (7), 511-519), MPC-11 (Cell (1976) 8 (3), 405-415), SP2/0 (Nature (1978) 276 (5685), 269-270), FO (J. Immunol. Methods (1980) 35 (1-2), 1-21), S194/5.XX0.BU.1 (J. Exp. Med. (1978) 148 (1), 313-323), and R210 (Nature (1979) 277 (5692), 131-133) can be preferably used as such myeloma cells.

Basically, the cell fusion of the immunocytes with the myeloma cells is performed according to a method known in the art, for example, the method of Kohler and Milstein et al. (Methods Enzymol. (1981) 73, 3-46).

More specifically, the cell fusion can be carried out, for example, in a usual nutrient medium in the presence of a cell fusion promoter. For example, polyethylene glycol (PEG) or hemagglutinating virus of Japan (HVJ) is used as the fusion promoter. In addition, an auxiliary such as dimethyl sulfoxide is added thereto for use, if desired, for enhancing fusion efficiency.

The ratio between the immunocytes and the myeloma cells used can be arbitrarily set. For example, the amount of the immunocytes is preferably set to 1 to 10 times the amount of the myeloma cells. For example, an RPMI1640 medium or a MEM medium suitable for the growth of the myeloma cell line as well as a usual medium for use in this kind of cell culture is used as the medium in the cell fusion. Preferably, a solution supplemented with serum (e.g., fetal calf serum (FCS)) can be further added to the medium.

For the cell fusion, the immunocytes and the myeloma cells are well mixed in the predetermined amounts in the medium. A PEG solution (e.g., average molecular weight of PEG: on the order of 1000 to 6000) preheated to approximately 37° C. is usually added thereto at a concentration of 30 to 60% (w/v). The mixed solution is gently mixed so that the desired fusion cells (hybridomas) are formed. Subsequently, the appropriate medium listed above is sequentially added to the cell cultures, and its supernatant is removed by centrifugation. This operation can be repeated to remove the cell fusion agents or the like unfavorable for hybridoma growth.

The hybridomas thus obtained can be cultured in a usual selective medium, for example, a HAT medium (medium containing hypoxanthine, aminopterin, and thymidine), for selection. The culture using the HAT medium can be continued for a time long enough to kill cells (non-fused cells) other than the desired hybridomas (usually, the time long enough is several days to several weeks). Subsequently, the hybridomas producing the desired antibody are screened for and single-cell cloned by a usual limiting dilution method.

The hybridomas thus obtained can be selected through the use of a selective medium appropriate for the selection marker of the myeloma cells used in the cell fusion. For example, the cells having the HGPRT or TK deficiency can be selected by culture in a HAT medium (medium containing hypoxanthine, aminopterin, and thymidine). Specifically, in the case of using HAT-sensitive myeloma cells in the cell fusion, only cells successfully fused with normal cells can be grown selectively in the HAT medium. The culture using the HAT medium is continued for a time long enough to kill cells (non-fused cells) other than the desired hybridomas. Specifically, the culture can generally be performed for several days to several weeks to select the desired hybridomas. Subsequently, the hybridomas producing the desired antibody can be screened for and single-cell cloned by a usual limiting dilution method.

The screening of the desired antibody and the single-cell cloning can be preferably carried out by a screening method based on antigen-antibody reaction known in the art. For example, the monoclonal antibody binding to IL-6R can bind to IL-6R expressed on cell surface. Such a monoclonal antibody can be screened for by, for example, FACS (fluorescence activated cell sorting). FACS is a system capable of measuring the binding of an antibody to cell surface by analyzing cells contacted with a fluorescent antibody using laser beam, and measuring the fluorescence emitted from the individual cells.

In order to screen for hybridomas producing the monoclonal antibody of the present invention by FACS, first, IL-6R-expressing cells are prepared. Cells preferred for screening are mammalian cells forced to express IL-6R. Untransformed mammalian cells used as the host cells can be used as a control to selectively detect the binding activity of an antibody against IL-6R on cell surface. Specifically, the hybridomas producing the monoclonal antibody against IL-6R can be obtained by selecting hybridomas producing an antibody binding to the cells forced to express IL-6R, without binding to the host cells.

Alternatively, the antibody can be evaluated for its binding activity against immobilized IL-6R-expressing cells on the basis of the principle of ELISA. The IL-6R-expressing cells are immobilized onto each well of, for example, an ELISA plate. The hybridoma culture supernatant is contacted with the immobilized cells in the well to detect an antibody binding to the immobilized cells. When the monoclonal antibody is derived from a mouse, the antibody bound with the cell can be detected using an anti-mouse immunoglobulin antibody. The hybridomas producing the desired antibody having antigen binding capacity, thus selected by screening, can be cloned by a limiting dilution method or the like.

The monoclonal antibody-producing hybridomas thus prepared can be subcultured in a usual medium. The hybridomas can also be preserved over a long period in liquid nitrogen.

The hybridomas are cultured according to a usual method, and the desired monoclonal antibody can be obtained from the culture supernatant thereof. Alternatively, the hybridomas may be administered to mammals compatible therewith and grown, and the monoclonal antibody can be obtained from the ascitic fluids thereof. The former method is suitable for obtaining highly pure antibodies.

An antibody encoded by an antibody gene cloned from the antibody-producing cells such as hybridomas can also be preferably used. The cloned antibody gene is integrated to an appropriate vector, which is then transfected into hosts so that the antibody encoded by the gene is expressed. Methods for the isolation of the antibody gene, the integration to a vector, and the transformation of host cells have already been established by, for example, Vandamme et al. (Eur. J. Biochem. (1990) 192 (3), 767-775). A method for producing a recombinant antibody as mentioned below is also known in the art.

For example, cDNA encoding the variable region (V region) of the anti-IL-6R antibody is obtained from the hybridoma cells producing the anti-IL-6R antibody. For this purpose, usually, total RNA is first extracted from the hybridomas. For example, any of the following methods can be used as a method for extracting mRNA from the cells:

a guanidine ultracentrifugation method (Biochemistry (1979) 18 (24), 5294-5299), and an AGPC method (Anal. Biochem. (1987) 162 (1), 156-159).

The extracted mRNA can be purified using mRNA Purification Kit (manufactured by GE Healthcare Bio-Sciences Corp.) or the like. Alternatively, a kit for directly extracting total mRNA from cells is also commercially available, such as QuickPrep mRNA Purification Kit (manufactured by GE Healthcare Bio-Sciences Corp.). The mRNA can be obtained from the hybridomas using such a kit. From the obtained mRNA, the cDNA encoding the antibody V region can be synthesized using reverse transcriptase. The cDNA can be synthesized using, for example, AMV Reverse Transcriptase First-strand cDNA Synthesis Kit (manufactured by Seikagaku Corp.). Alternatively, a 5'-RACE method (Proc. Natl. Acad. Sci. USA (1988) 85 (23), 8998-9002; and Nucleic Acids Res. (1989) 17 (8), 2919-2932) using SMART RACE cDNA amplification kit (manufactured by Clontech Laboratories, Inc.) and PCR can be appropriately used for the cDNA synthesis and amplification. In the course of such cDNA synthesis, appropriate restriction sites mentioned later can be further introduced to both ends of the cDNA.

The cDNA fragment of interest is purified from the obtained PCR product and subsequently ligated with vector DNA. The recombinant vector thus prepared is transfected into E. coli or the like. After colony selection, the desired recombinant vector can be prepared from the E. coli that has formed the colony. Then, whether or not the recombinant vector has the nucleotide sequence of the cDNA of interest is confirmed by a method known in the art, for example, a dideoxynucleotide chain termination method.

The 5'-RACE method using primers for variable region gene amplification is conveniently used for obtaining the gene encoding the variable region. First, a 5'-RACE cDNA library is obtained by cDNA synthesis with RNAs extracted from the hybridoma cells as templates. A commercially available kit such as SMART RACE cDNA amplification kit is appropriately used in the synthesis of the 5'-RACE cDNA library.

The antibody gene is amplified by PCR with the obtained 5'-RACE cDNA library as a template. Primers for mouse antibody gene amplification can be designed on the basis of an antibody gene sequence known in the art. These primers have nucleotide sequences differing depending on immunoglobulin subclasses. Thus, the subclass is desirably determined in advance using a commercially available kit such as Iso Strip mouse monoclonal antibody isotyping kit (Roche Diagnostics K.K.).

Specifically, primers capable of amplifying genes encoding γ1, γ2a, γ2b, and γ3 heavy chains and κ and λ light chains can be used, for example, for the purpose of obtaining a gene encoding mouse IgG. In order to amplify an IgG variable region gene, a primer that anneals to a moiety corresponding to a constant region close to the variable region is generally used as a 3' primer. On the other hand, a primer attached to the 5' RACE cDNA library preparation kit is used as a 5' primer.

The PCR products thus obtained by amplification can be used to reshape immunoglobulins composed of heavy and light chains in combination. The desired antibody can be screened for with the binding activity of the reshaped immunoglobulin against IL-6R as an index. More preferably, the binding of the antibody to IL-6R is specific, for example, for the purpose of obtaining the antibody against IL-6R. The antibody binding to IL-6R can be screened for, for example, by the following steps:

(1) contacting an antibody containing the V region encoded by the cDNA obtained from the hybridomas, with IL-6R-expressing cells;
(2) detecting the binding of the antibody to the IL-6R-expressing cells; and
(3) selecting the antibody binding to the IL-6R-expressing cells.

A method for detecting the binding of the antibody to the IL-6R-expressing cells is known in the art. Specifically, the binding of the antibody to the IL-6R-expressing cells can be detected by an approach such as FACS mentioned above. A fixed preparation of IL-6R-expressing cells can be appropriately used for evaluating the binding activity of the antibody.

A panning method using phage vectors is also preferably used as a method for screening for the antibody with binding activity as an index. When antibody genes are obtained as libraries of heavy chain and light chain subclasses from a polyclonal antibody-expressing cell population, a screening method using phage vectors is advantageous. Genes encoding heavy chain and light chain variable regions can be linked via an appropriate linker sequence to form a gene encoding single-chain Fv (scFv). The gene encoding scFv can be inserted into phage vectors to obtain phages expressing scFv on their surface. After contact of the phages with the desired antigen, phages bound with the antigen can be recovered to recover DNA encoding scFv having the binding activity of interest. This operation can be repeated, if necessary, to enrich scFvs having the desired binding activity.

After the obtainment of the cDNA encoding the V region of the anti-IL-6R antibody of interest, this cDNA is digested with restriction enzymes that recognize the restriction sites inserted at both ends of the cDNA. The restriction enzymes preferably recognize and digest a nucleotide sequence that appears low frequently in the nucleotide sequence constituting the antibody gene. The insertion of sites for restriction enzymes that provide cohesive ends is preferred for inserting one copy of the digested fragment in the correct orientation into a vector. The thus-digested cDNA encoding the V region of the anti-IL-6R antibody can be inserted into an appropriate expression vector to obtain an antibody expression vector. In this case, a gene encoding an antibody constant region (C region) and the gene encoding the V region are fused in frame to obtain a chimeric antibody. In this context, the "chimeric antibody" refers to an antibody having constant and variable regions of different origins. Thus, heterogeneous (e.g., mouse-human) chimeric antibodies as well as human-human homogeneous chimeric antibodies are also included in the chimeric antibody according to the present invention. The V region gene can be inserted into an expression vector preliminarily having a constant region gene to construct a chimeric antibody expression vector. Specifically, for example, recognition sequences for restriction enzymes digesting the V region gene can be appropriately placed on the 5' side of an expression vector carrying the DNA encoding the desired antibody constant region (C region). This expression vector having the C region gene and the V region gene are digested with the same combination of restriction enzymes and fused in frame to construct a chimeric antibody expression vector.

In order to produce the anti-IL-6R monoclonal antibody, the antibody gene is integrated to an expression vector such that the antibody gene is expressed under the control of expression control regions. The expression control regions for antibody expression include, for example, an enhancer and a promoter. Also, an appropriate signal sequence can be added to the amino terminus such that the expressed antibody is extracellularly secreted. For example, a peptide having an amino acid sequence MGWSCIILFL-VATATGVHS (SEQ ID NO: 536) can be used as the signal sequence. Any of other suitable signal sequences may be added thereto. The expressed polypeptide is cleaved at the carboxyl-terminal moiety of this sequence. The cleaved polypeptide can be extracellularly secreted as a mature polypeptide. Subsequently, appropriate host cells can be transformed with this expression vector to obtain recombinant cells expressing the DNA encoding the anti-IL-6R antibody.

The "antibody fragment" refers to a molecule, other than a complete antibody, containing a portion of the complete antibody and binding to an antigen to which the complete antibody binds. Examples of the antibody fragment include, but are not limited to, Fv, Fab, Fab', Fab'-SH, F(ab')2, diabody, linear antibodies, single-chain antibody molecules (e.g., scFv), and multispecific antibodies formed from antibody fragments.

The terms "full-length antibody", "complete antibody", and "whole antibody" are used interchangeably with each other in the present specification and refer to an antibody having a structure substantially similar to a natural antibody structure, or having heavy chains containing a Fc region defined in the present specification.

The term "variable region" or "variable domain" refers to a region or a domain of an antibody heavy chain or light chain involved in the binding of the antibody to its antigen. Usually, antibody heavy chain and light chain variable domains (VH and VL, respectively) are structurally similar and each contain 4 conserved framework regions (FRs) and 3 complementarity determining regions (CDRs) (see e.g., Kindt et al., Kuby Immunology, 6th ed., W.H. Freeman and Co., page 91 (2007)). One VH or VL domain may suffice for conferring antigen binding specificity.

The term "complementarity determining region" or "CDR" used in the present specification is hypervariable in the sequence, and/or forms a structurally determined loop ("hypervariable loop"), and/or refers to antigen contact residues ("antigen contacts") or each region of an antibody variable domain. Usually, an antibody contains 6 CDRs: three in VH (H1, H2, and H3), and three in VL (L1, L2, and L3). In the present specification, exemplary CDRs include the following:

(a) hypervariable loops formed at amino acid residues 26 to 32 (L1), 50 to 52 (L2), 91 to 96 (L3), 26 to 32 (H1), 53 to 55 (H2), and 96 to 101 (H3) (Chothia and Lesk, J. Mol. Biol. 196: 901-917 (1987));

(b) CDRs formed at amino acid residues 24 to 34 (L1), 50 to 56 (L2), 89 to 97 (L3), 31 to 35b (H1), 50 to 65 (H2), and 95 to 102 (H3) (Kabat et al., Sequences of Proteins of Immunological Interest, 5th Ed. Public Health Service, National Institutes of Health, Bethesda, MD (1991));

(c) antigen contacts formed at amino acid residues 27c to 36 (L1), 46 to 55 (L2), 89 to 96 (L3), 30 to 35b (H1), 47 to 58 (H2), and 93 to 101 (H3) (MacCallum et al., J. Mol. Biol. 262: 732-745 (1996)); and (d) a combination of (a), (b), and/or (c) containing HVR amino acid residues 46 to 56 (L2), 47 to 56 (L2), 48 to 56 (L2), 49 to 56 (L2), 26 to 35 (H1), 26 to 35b (H1), 49 to 65 (H2), 93 to 102 (H3), and 94 to 102 (H3).

In the present specification, CDR residues and other residues (e.g., FR residues) in a variable domain are numbered according to Kabat et al. (supra), unless otherwise specified.

The term "framework" or "FR" refers to variable domain residues other than complementarity determining region (CDR) residues. FRs in a variable domain consist of 4 FR domains: FR1, FR2, FR3, and FR4. Accordingly, the sequences of CDRs and FRs usually appear in VH (or VL) in the following order: FR1-H1 (L1)-FR2-H2 (L2)-FR3-H3 (L3)-FR4.

In the present specification, the term "constant region" or "constant domain" refers to a region or a domain other than variable regions in an antibody. For example, an IgG antibody is a heterotetrameric glycoprotein of approximately 150,000 Da constituted by two identical light chains and two identical heavy chains connected through disulfide bonds. Each heavy chain has a variable region (VH) also called variable heavy chain domain or heavy chain variable domain, followed by a heavy chain constant region (CH) containing a CH1 domain, a hinge region, a CH2 domain, and a CH3 domain, from the N terminus toward the C terminus. Likewise, each light chain has a variable region (VL) also called variable light chain domain or light chain variable domain, followed by a constant light chain (CL) domain, from the N terminus toward the C terminus. The light chains of natural antibodies may be attributed to one of two types called kappa (κ) and lambda (λ) on the basis of the amino acid sequences of their constant domains.

The "class" of an antibody refers to the type of a constant domain or a constant region carried by the heavy chain of the antibody. Antibodies have 5 major classes: IgA, IgD, IgE, IgG, and IgM. Some of these classes may be further divided into subclasses (isotypes), for example, IgG1, IgG2, IgG3, IgG4, IgA1, and IgA2. Heavy chain constant domains corresponding to immunoglobulins of different classes are called α, δ, ε, γ, and μ, respectively.

In the present specification, the term "Fc region" is used for defining the C-terminal region of immunoglobulin heavy chains, including at least a portion of constant regions. This term includes a Fc region having a natural sequence and a mutant Fc region. In one aspect, the heavy chain Fc region of human IgG1 spans from Cys226 or Pro230 to the carboxyl terminus of the heavy chain. However, the C-terminal lysine (Lys447) or glycine-lysine (Gly446-Lys447) of the Fc region may be present or absent. In the present specification, amino acid residues in a Fc region or a constant region are numbered according to the EU numbering system (also called EU index) described in Kabat et al., Sequences of Proteins of Immunological Interest, 5th Ed. Public Health Service, National Institutes of Health, Bethesda, MD 1991, unless otherwise specified.

The ligand binding molecule of the present invention is a polypeptide comprising a cleavage site. The cleavage site can be cleaved by, for example, an enzyme, can be reduced with a reducing agent, or can be photodegraded. The cleavage site may be placed at any position in the polypeptide as long as the ligand binding of the ligand binding molecule can be attenuated by the cleavage of the cleavage site. The polypeptide may contain one or more cleavage sites.

The ligand binding molecule of the present invention binds to the ligand more weakly (i.e., ligand binding is attenuated) in a cleaved state compared with an uncleaved state. In an embodiment in which the ligand binding of the ligand binding molecule is based on antigen-antibody reaction, the attenuation of the ligand binding can be evaluated on the basis of the ligand binding activity of the ligand binding molecule.

The ligand binding activity of the ligand binding molecule can be confirmed by a well-known method such as FACS, an ELISA format, a BIACORE method using ALPHA (amplified luminescent proximity homogeneous assay) screening or surface plasmon resonance (SPR) phenomena, or BLI (bio-layer interferometry) (Octet) (Proc. Natl. Acad. Sci. USA (2006) 103 (11), 4005-4010).

The ALPHA screening is carried out on the basis of the following principle according to ALPHA technology using two beads, a donor and an acceptor. Luminescence signals are detected only when these two beads are located in proximity through the interaction between a molecule bound with the donor bead and a molecule bound with the acceptor bead. A laser-excited photosensitizer in the donor bead converts ambient oxygen to singlet oxygen in an excited state. The singlet oxygen diffuses around the donor bead and reaches the acceptor bead located in proximity thereto to thereby cause chemiluminescent reaction in the bead, which finally emits light. In the absence of the interaction between the molecule bound with the donor bead and the molecule bound with the acceptor bead, no chemiluminescent reaction occurs because singlet oxygen produced by the donor bead does not reach the acceptor bead.

For example, a biotin-labeled ligand binding molecule is bound to the donor bead, while a glutathione S transferase (GST)-tagged ligand is bound to the acceptor bead. In the absence of an untagged competitor ligand binding molecule, the ligand binding molecule interacts with the ligand to generate signals of 520 to 620 nm. The untagged ligand binding molecule competes with the tagged ligand binding molecule for the interaction with the ligand. Decrease in fluorescence resulting from the competition can be quantified to determine relative binding affinity. The biotinylation of the ligand binding molecule such as an antibody using sulfo-NHS-biotin or the like is known in the art. A method which involves, for example: fusing a polynucleotide encoding the ligand in flame with a polynucleotide encoding GST; expressing a GST-fused ligand from cells or the like carrying a vector that permits expression of the resulting fusion gene; and purifying the GST-fused ligand using a glutathione column can be appropriately adopted as a method for tagging the ligand with GST. The obtained signals are preferably analyzed using, for example, software GRAPH-PAD PRISM (GraphPad Software, Inc., San Diego) adapted to a one-site competition model based on nonlinear regression analysis.

One (ligand) of the substances between which the interaction is to be observed is immobilized onto a thin gold film of a sensor chip. The sensor chip is irradiated with light from the back such that total reflection occurs at the interface between the thin gold film and glass. As a result, a site having a drop in reflection intensity (SPR signal) is formed in a portion of reflected light. The other (analyte) of the substances between which the interaction is to be observed is flowed on the surface of the sensor chip and bound to the ligand so that the mass of the immobilized ligand molecule is increased to change the refractive index of the solvent on the sensor chip surface. This change in the refractive index shifts the position of the SPR signal (on the contrary, the dissociation of the bound molecules gets the signal back to the original position). The Biacore system plots on the ordinate the amount of the shift, i.e., change in mass on the sensor chip surface, and displays time-dependent change in mass as assay data (sensorgram). Kinetics: an association rate constant (ka) and a dissociation rate constant (kd) are determined from the curve of the sensorgram, and a dissociation constant (KD) is determined from the ratio between these constants. Inhibition assay or equilibrium analysis is also preferably used in the BIACORE method. Examples of the inhibition assay are described in Proc. Natl. Acad. Sci. USA (2006) 103 (11), 4005-4010, and examples of the equilibrium analysis are described in Methods Enzymol. 2000; 323: 325-40.

The phrase "ligand binding function of the ligand binding molecule is attenuated" means that the amount of a test ligand binding molecule bound with the ligand is, for example, 50% or less, preferably 45% or less, 40% or less, 35% or less, 30% or less, 20% or less, or 15% or less, particularly preferably 10% or less, 9% or less, 8% or less, 7% or less, 6% or less, 5% or less, 4% or less, 3% or less, 2% or less, or 1% or less, of the amount of a control ligand binding molecule bound with the ligand on the basis of the measurement method described above. The desired index may be appropriately used as an index for binding activity. For example, a dissociation constant (KD) may be used. In the case of using a dissociation constant (KD) as an index for evaluating binding activity, a larger dissociation constant (KD) of the test ligand binding molecule for the ligand than that of a control ligand binding molecule for the ligand means that the test ligand binding molecule has weaker binding activity against the ligand than that of the control ligand binding molecule. The phrase "ligand binding function is attenuated" means that the dissociation constant (KD) of the test ligand binding molecule for the ligand is, for example, at least 2 times, preferably at least 5 times or at least 10 times, particularly preferably at least 100 times the dissociation constant (KD) of the control ligand binding molecule for the ligand.

Examples of the control ligand binding molecule include an uncleaved form of the ligand binding molecule.

In one embodiment of the present invention, the ligand is released from the ligand binding molecule of the present invention by the cleavage of the cleavage site in the ligand binding molecule. In this context, when the ligand is bound with a portion of the ligand binding molecule via a linker having no cleavage site, the ligand is released while connected with this portion of the ligand binding molecule via the linker (see e.g., FIG. 1). Even when the ligand is released together with a portion of the ligand binding molecule as mentioned above, it can be concluded that the ligand is released from the ligand binding molecule as long as the ligand is released from the most part of the ligand binding molecule.

A method for detecting the release of the ligand from the ligand binding molecule by the cleavage of the cleavage site includes a method of detecting the ligand using, for example, an antibody for ligand detection that recognizes the ligand. When the ligand binding molecule is an antibody fragment, the antibody for ligand detection preferably binds to the same epitope as that for the ligand binding molecule. The ligand detected using the antibody for ligand detection can be confirmed by a well-known method such as FACS, an ELISA format, a BIACORE method using ALPHA (amplified luminescent proximity homogeneous assay) screening or surface plasmon resonance (SPR) phenomena, or BLI (bio-layer interferometry) (Octet) (Proc. Natl. Acad. Sci. USA (2006) 103 (11), 4005-4010).

In the case of detecting the release of the ligand using, for example, Octet, the antibody for ligand detection that recognizes the ligand is biotinylated and contacted with a biosensor. Then, binding to the ligand in a sample can be measured to detect the release of the ligand. Specifically, the amount of the ligand is measured in a sample containing the ligand binding molecule before protease treatment or after protease treatment and the ligand, using the antibody for ligand detection. The amount of the ligand detected in the sample can be compared between before and after protease treatment to detect the release of the ligand. Alternatively, the amount of the ligand is measured in a sample containing protease, the ligand binding molecule, and the ligand and a sample containing the ligand binding molecule and the ligand without containing protease, using the antibody for ligand detection. The amount of the ligand detected in the sample can be compared between the presence and absence of protease to detect the release of the ligand. More specifically, the release of the ligand can be detected by a method described in Examples of the present application. When the ligand binding molecule is fused with the ligand to form a fusion protein, the amount of the ligand is measured in a sample containing the fusion protein before protease treatment or after protease treatment, using the antibody for ligand detection. The amount of the ligand detected in the sample can be compared between before and after protease treatment to detect the release of the ligand. Alternatively, the amount of the ligand is measured in a sample containing protease and the fusion protein and a sample containing the fusion protein without containing protease, using the antibody for ligand detection. The amount of the ligand detected in the sample can be compared between the presence and absence of protease to detect the release of the ligand. More specifically, the release of the ligand can be detected by a method described in Examples of the present application.

In an embodiment in which the physiological activity of the ligand is inhibited upon binding to the ligand binding molecule, the release from the ligand binding molecule can be detected by a method of measuring the physiological activity of the ligand in a sample. Specifically, the physiological activity of the ligand can be measured in a sample containing the ligand binding molecule before protease treatment or after protease treatment and the ligand and compared between before and after protease treatment to detect the release of the ligand. Alternatively, the physiological activity of the ligand can be measured in a sample containing protease, the ligand binding molecule, and the ligand and a sample containing the ligand binding molecule and the ligand without containing protease and compared between these samples to detect the release of the ligand. When the ligand binding molecule is fused with the ligand to form a fusion protein, the physiological activity of the ligand can be measured in a sample containing the fusion protein before protease treatment or after protease treatment and compared between before and after protease treatment to detect the release of the ligand. Alternatively, the physiological activity of the ligand can be measured in a sample containing protease and the fusion protein and a sample containing the fusion protein without containing protease and compared between these samples to detect the release of the ligand.

In one embodiment of the present invention, the cleavage site comprises a protease cleavage sequence and is cleaved by protease.

In the present specification, the term "protease" refers to an enzyme such as endopeptidase or exopeptidase which hydrolyzes a peptide bond, typically, endopeptidase. The protease used in the present invention is limited only by being capable of cleaving the protease cleavage sequence and is not particularly limited by its type. In some embodiments, target tissue specific protease is used. The target tissue specific protease can refer to, for example, any of (1) protease that is expressed at a higher level in the target tissue than in normal tissues, (2) protease that has higher activity in the target tissue than in normal tissues, (3) protease that is expressed at a higher level in the target cells than in normal cells, and (4) protease that has higher activity in the target cells than in normal cells.

In a more specific embodiment, a cancer tissue specific protease or an inflammatory tissue specific protease is used.

In the present specification, the term "target tissue" means a tissue containing at least one target cell. In some embodiments of the present invention, the target tissue is a cancer tissue. In some embodiments of the present invention, the target tissue is an inflammatory tissue.

The term "cancer tissue" means a tissue containing at least one cancer cell. Thus, considering that, for example, the cancer tissue contains cancer cells and vascular vessels, every cell type that contributes to the formation of tumor mass containing cancer cells and endothelial cells is included in the scope of the present invention. In the present specification, the tumor mass refers to a foci of tumor tissue. The term "tumor" is generally used to mean benign neoplasm or malignant neoplasm.

In the present specification, examples of the "inflammatory tissue" include the following:

a joint tissue in rheumatoid arthritis or osteoarthritis, a lung (alveolus) tissue in bronchial asthma or COPD, a digestive organ tissue in inflammatory bowel disease, Crohn disease, or ulcerative colitis, a fibrotic tissue in fibrosis in the liver, the kidney, or the lung, a tissue under rejection of organ transplantation, a vascular vessel or heart (cardiac muscle) tissue in arteriosclerosis or heart failure, a visceral fat tissue in metabolic syndrome, a skin tissue in atopic dermatitis and other dermatitides, and a spinal nerve tissue in disk herniation or chronic lumbago.

Specifically expressed or specifically activated protease, or protease considered to be related to the disease condition of a target tissue (target tissue specific protease) is known for some types of target tissues. For example, International Publication Nos. WO2013/128194, WO2010/081173, and WO2009/025846 disclose protease specifically expressed in a cancer tissue. Also, J Inflamm (Lond). 2010; 7: 45, Nat Rev Immunol. 2006 July; 6 (7): 541-50, Nat Rev Drug Discov. 2014 December; 13 (12): 904-27, Respir Res. 2016 Mar. 4; 17: 23, Dis Model Mech. 2014 February; 7 (2): 193-203, and Biochim Biophys Acta. 2012 January; 1824 (1): 133-45 disclose protease considered to be related to inflammation.

In addition to the protease specifically expressed in a target tissue, there also exists protease specifically activated in a target tissue. For example, protease may be expressed in an inactive form and then converted to an active form. Many tissues contain a substance inhibiting active protease and control the activity by the process of activation and the presence of the inhibitor (Nat Rev Cancer. 2003 July; 3 (7): 489-501). In a target tissue, the active protease may be specifically activated by escaping inhibition.

The active protease can be measured by use of a method using an antibody recognizing the active protease (PNAS 2013 Jan. 2; 110 (1): 93-98) or a method of fluorescently labeling a peptide recognizable by protease so that the fluorescence is quenched before cleavage, but emitted after cleavage (Nat Rev Drug Discov. 2010 September; 9 (9): 690-701. doi: 10.1038/nrd3053).

From one viewpoint, the term "target tissue specific protease" can refer to any of (i) protease that is expressed at a higher level in the target tissue than in normal tissues,
(ii) protease that has higher activity in the target tissue than in normal tissues,
(iii) protease that is expressed at a higher level in the target cells than in normal cells, and
(iv) protease that has higher activity in the target cells than in normal cells.

Specific examples of the protease include, but are not limited to, cysteine protease (including cathepsin families B, L, S, etc.), aspartyl protease (cathepsins D, E, K, O, etc.), serine protease (including matriptase (including MT-SP1), cathepsins A and G, thrombin, plasmin, urokinase (uPA), tissue plasminogen activator (tPA), elastase, proteinase 3, thrombin, kallikrein, tryptase, and chymase), metalloproteinase (metalloproteinase (MMP1-28) including both membrane-bound forms (MMP14-17 and MMP24-25) and secreted forms (MMP1-13, MMP18-23 and MMP26-28), A disintegrin and metalloproteinase (ADAM), A disintegrin and metalloproteinase with thrombospondin motifs (ADAMTS), meprin (meprin alpha and meprin beta), CD10 (CALLA), prostate-specific antigen (PSA), legumain, TMPRSS3, TMPRSS4, human neutrophil elastase (HNE), beta secretase (BACE), fibroblast activation protein alpha (FAP), granzyme B, guanidinobenzoatase (GB), hepsin, neprilysin, NS3/4A, HCV-NS3/4, calpain, ADAMDEC1, renin, cathepsin C, cathepsin V/L2, cathepsin X/Z/P, cruzipain, otubain 2, kallikrein-related peptidases (KLKs (KLK3, KLK4, KLK5, KLK6, KLK7, KLK8, KLK10, KLK11, KLK13, and KLK14)), bone morphogenetic protein 1 (BMP-1), activated protein C, blood coagulation-related protease (Factor VIIa, Factor IXa, Factor Xa, Factor XIa, and Factor XIIa), HtrA1, lactoferrin, marapsin, PACE4, DESC1, dipeptidyl peptidase 4 (DPP-4), TMPRSS2, cathepsin F, cathepsin H, cathepsin L2, cathepsin 0, cathepsin S, granzyme A, Gepsin calpain 2, glutamate carboxypeptidase 2, AMSH-like proteases, AMSH, gamma secretase, antiplasmin cleaving enzyme (APCE), decysin 1, N-acetylated alpha-linked acidic dipeptidase-like 1 (NAALADL1), and furin.

From another viewpoint, the target tissue specific protease can refer to cancer tissue specific protease or inflammatory tissue specific protease.

Examples of the cancer tissue specific protease include protease specifically expressed in a cancer tissue disclosed in International Publication Nos. WO2013/128194, WO2010/081173, and WO2009/025846.

As for the type of the cancer tissue specific protease, the protease having higher expression specificity in the cancer tissue to be treated is more effective for reducing adverse reactions. Preferable cancer tissue specific protease has a concentration in the cancer tissue at least 5 times, more preferably at least 10 times, further preferably at least 100 times, particularly preferably at least 500 times, most preferably at least 1000 times higher than its concentration in normal tissues. Also, preferable cancer tissue specific protease has activity in the cancer tissue at least 2 times, more preferably at least 3 times, at least 4 times, at least 5 times, or at least 10 times, further preferably at least 100 times, particularly preferably at least 500 times, most preferably at least 1000 times higher than its activity in normal tissues.

The cancer tissue specific protease may be in a form bound with a cancer cell membrane or may be in a form secreted extracellularly without being bound with a cell membrane. When the cancer tissue specific protease is not bound with a cancer cell membrane, it is preferred for immunocyte-mediated cytotoxicity specific for cancer cells that the cancer tissue specific protease should exist within or in the vicinity of the cancer tissue. In the present specification, the "vicinity of the cancer tissue" means to fall within the scope of location where the protease cleavage sequence specific for the cancer tissue is cleaved so that the effect of reducing the ligand binding activity is exerted. However, it is preferred that damage on normal cells should be minimized in this scope of location.

From an alternative viewpoint, cancer tissue specific protease is any of
(i) protease that is expressed at a higher level in the cancer tissue than in normal tissues,
(ii) protease that has higher activity in the cancer tissue than in normal tissues,
(iii) protease that is expressed at a higher level in the cancer cells than in normal cells, and
(iv) protease that has higher activity in the cancer cells than in normal cells.

One type of cancer tissue specific protease may be used alone, or two or more types of cancer tissue specific proteases may be combined. The number of types of the cancer tissue specific protease can be appropriately set by those skilled in the art in consideration of the cancer type to be treated.

From these viewpoints, the cancer tissue specific protease is preferably serine protease or metalloproteinase, more preferably matriptase (including MT-SP1), urokinase (uPA), or metalloproteinase, further preferably MT-SP1, uPA, MMP2, or MMP9, among the proteases listed above.

As for the type of inflammatory tissue specific protease, the protease having higher expression specificity in the inflammatory tissue to be treated is more effective for reducing adverse reactions. Preferable inflammatory tissue specific protease has a concentration in the inflammatory tissue at least 5 times, more preferably at least 10 times, further preferably at least 100 times, particularly preferably at least 500 times, most preferably at least 1000 times higher than its concentration in normal tissues. Also, preferable inflammatory tissue specific protease has activity in the inflammatory tissues at least 2 times, more preferably at least 3 times, at least 4 times, at least 5 times, or at least 10 times, further preferably at least 100 times, particularly preferably at least 500 times, most preferably at least 1000 times higher than its activity in normal tissues.

The inflammatory tissue specific protease may be in a form bound with an inflammatory cell membrane or may be in a form secreted extracellularly without being bound with a cell membrane. When the inflammatory tissue specific protease is not bound with an inflammatory cell membrane, it is preferred for immunocyte-mediated cytotoxicity specific for inflammatory cells that the inflammatory tissue specific protease should exist within or in the vicinity of the inflammatory tissue. In the present specification, the "vicinity of the inflammatory tissue" means to fall within the scope of location where the protease cleavage sequence specific for the inflammatory tissue is cleaved so that the effect of reducing the ligand binding activity is exerted. However, it is preferred that damage on normal cells should be minimized in this scope of location.

From an alternative viewpoint, inflammatory tissue specific protease is any of
(i) protease that is expressed at a higher level in the inflammatory tissue than in normal tissues,
(ii) protease that has higher activity in the inflammatory tissue than in normal tissues,
(iii) protease that is expressed at a higher level in the inflammatory cells than in normal cells, and (iv) protease that has higher activity in the inflammatory cells than in normal cells.

One type of inflammatory tissue specific protease may be used alone, or two or more types of inflammatory tissue specific proteases may be combined. The number of types of the inflammatory tissue specific protease can be appropriately set by those skilled in the art in consideration of the pathological condition to be treated.

From these viewpoints, the inflammatory tissue specific protease is preferably metalloproteinase among the proteases listed above. The metalloproteinase is more preferably ADAMTS5, MMP2, MMP7, MMP9, or MMP13.

The protease cleavage sequence is a particular amino acid sequence that is specifically recognized by target tissue specific protease when the polypeptide is hydrolyzed by the target tissue specific protease in an aqueous solution.

The protease cleavage sequence is preferably an amino acid sequence that is hydrolyzed with high specificity by target tissue specific protease more specifically expressed in the target tissue or cells to be treated or more specifically activated in the target tissue/cells to be treated, from the viewpoint of reduction in adverse reactions.

Specific examples of the protease cleavage sequence include target sequences that are specifically hydrolyzed by the above-listed protease specifically expressed in a cancer tissue disclosed in International Publication Nos. WO2013/128194, WO2010/081173, and WO2009/025846, the inflammatory tissue specific protease, and the like. A sequence artificially altered by, for example, appropriately introducing an amino acid mutation to a target sequence that is specifically hydrolyzed by known protease can also be used. Alternatively, a protease cleavage sequence identified by a method known to those skilled in the art as described in Nature Biotechnology 19, 661-667 (2001) may be used.

Furthermore, a naturally occurring protease cleavage sequence may be used. For example, TGF is converted to a latent form by protease cleavage. Likewise, a protease cleavage sequence in a protein that changes its molecular form by protease cleavage can also be used.

Examples of the protease cleavage sequence that can be used include, but are not limited to, sequences disclosed in International Publication No. WO2015/116933, International Publication No. WO2015/048329, International Publication No. WO2016/118629, International Publication No. WO2016/179257, International Publication No. WO2016/179285, International Publication No. WO2016/179335, International Publication No. WO2016/179003, International Publication No. WO2016/046778, International Publication No. WO2016/014974, U.S. Patent Publication No. US2016/0289324, U.S. Patent Publication No. US2016/0311903, PNAS (2000) 97: 7754-7759, Biochemical Journal (2010) 426: 219-228, and Beilstein J Nanotechnol. (2016) 7: 364-373.

The protease cleavage sequence is more preferably an amino acid sequence that is specifically hydrolyzed by suitable target tissue specific protease as mentioned above. The amino acid sequence that is specifically hydrolyzed by target tissue specific protease is preferably any of the following amino acid sequences:

(SEQ ID NO: 3, cleavable by MT-SP1 or uPA)
LSGRSDNH, (SEQ ID NO: 34, cleavable by MMP2 or MMP9)
PLGLAG,
and (SEQ ID NO: 35, cleavable by MMP7)
VPLSLTMG.

Any of the following sequences can also be used as the protease cleavage sequence:
(SEQ ID NO: 66, cleavable by MT-SP1 or uPA)
TSTSGRSANPRG, (SEQ ID NO: 67, cleavable by MT-SP1 or uPA)
ISSGLLSGRSDNH, (SEQ ID NO: 68, cleavable by MT-SP1 or uPA)
AVGLLAPPGGLSGRSDNH, (SEQ ID NO: 69, cleavable by MMP1)
GAGVPMSMRGGAG, (SEQ ID NO: 70, cleavable by MMP2)
GAGIPVSLRSGAG, (SEQ ID NO: 71, cleavable by MMP2)
GPLGIAGQ, (SEQ ID NO: 72, cleavable by MMP2)
GGPLGMLSQS, (SEQ ID NO: 73, cleavable by MMP2)
PLGLWA, (SEQ ID NO: 74, cleavable by MMP3)
GAGRPFSMIMGAG, (SEQ ID NO: 75, cleavable by MMP7)
GAGVPLSLTMGAG, (SEQ ID NO: 76, cleavable by MMP9)
GAGVPLSLYSGAG, (SEQ ID NO: 77, cleavable by MMP11)
AANLRN, (SEQ ID NO: 78, cleavable by MMP11)
AQAYVK, (SEQ ID NO: 79, cleavable by MMP11)
AANYMR, (SEQ ID NO: 80, cleavable by MMP11)
AAALTR, (SEQ ID NO: 81, cleavable by MMP11)
AQNLMR, (SEQ ID NO: 82, cleavable by MMP11)
AANYTK, (SEQ ID NO: 83, cleavable by MMP13)
GAGPQGLAGQRGIVAG, (SEQ ID NO: 84, cleavable by pro-urokinase)
PRFKIIGG, (SEQ ID NO: 85, cleavable by pro-urokinase)
PRFRIIGG, (SEQ ID NO: 86, cleavable by uPA)
GAGSGRSAG, (SEQ ID NO: 87, cleavable by uPA)
SGRSA, (SEQ ID NO: 88, cleavable by uPA)
GSGRSA, (SEQ ID NO: 89, cleavable by uPA)
SGKSA, (SEQ ID NO: 90, cleavable by uPA)
SGRSS, -continued (SEQ ID NO: 91, cleavable by uPA)
SGRRA, (SEQ ID NO: 92, cleavable by uPA)
SGRNA, (SEQ ID NO: 93, cleavable by uPA)
SGRKA, (SEQ ID NO: 94, cleavable by tPA)
QRGRSA, (SEQ ID NO: 95, cleavable by cathepsin B)
GAGSLLKSRMVPNFNAG, (SEQ ID NO: 96, cleavable by cathepsin B)
TQGAAA, (SEQ ID NO: 97, cleavable by cathepsin B)
GAAAAA, (SEQ ID NO: 98, cleavable by cathepsin B)
GAGAAG, (SEQ ID NO: 99, cleavable by cathepsin B)
AAAAAG, (SEQ ID NO: 100, cleavable by cathepsin B)
LCGAAI, (SEQ ID NO: 101, cleavable by cathepsin B)
FAQALG, (SEQ ID NO: 102, cleavable by cathepsin B)
LLQANP, (SEQ ID NO: 103, cleavable by cathepsin B)
LAAANP, (SEQ ID NO: 104, cleavable by cathepsin B)
LYGAQF, (SEQ ID NO: 105, cleavable by cathepsin B)
LSQAQG, (SEQ ID NO: 106, cleavable by cathepsin B)
ASAASG, (SEQ ID NO: 107, cleavable by cathepsin B)
FLGASL, (SEQ ID NO: 108, cleavable by cathepsin B)
AYGATG, (SEQ ID NO: 109, cleavable by cathepsin B)
LAQATG, (SEQ ID NO: 110, cleavable by cathepsin L)
GAGSGVVIATVIVITAG, (SEQ ID NO: 111, cleavable by meprin alpha or meprin beta)
APMAEGGG, (SEQ ID NO: 112, cleavable by meprin alpha or meprin beta)
EAQGDKII, (SEQ ID NO: 113, cleavable by meprin alpha or meprin beta)
LAFSDAGP, (SEQ ID NO: 114, cleavable by meprin alpha or meprin beta)
YVADAPK, (SEQ ID NO: 115, cleavable by furin)
RRRRR, (SEQ ID NO: 116, cleavable by furin)
RRRRRR, (SEQ ID NO: 117, cleavable by furin)
GQSSRHRRAL, (SEQ ID NO: 118)
SSRHRRALD, (SEQ ID NO: 119, cleavable by plasminogen)
RKSSIIIRMRDVVL, (SEQ ID NO: 120, cleavable by staphylokinase)
SSSFDKGKYKKGDDA, (SEQ ID NO: 121, cleavable by staphylokinase)
SSSFDKGKYKRGDDA, (SEQ ID NO: 122, cleavable by Factor IXa)
IEGR, (SEQ ID NO: 123, cleavable by Factor IXa)
IDGR, (SEQ ID NO: 124, cleavable by Factor IXa)
GGSIDGR, (SEQ ID NO: 125, cleavable by collagenase)
GPQGIAGQ, (SEQ ID NO: 126, cleavable by collagenase)
GPQGLLGA, (SEQ ID NO: 127, cleavable by collagenase)
GIAGQ, (SEQ ID NO: 128, cleavable by collagenase)
GPLGIAG, (SEQ ID NO: 129, cleavable by collagenase)
GPEGLRVG, (SEQ ID NO: 130, cleavable by collagenase)
YGAGLGVV, (SEQ ID NO: 131, cleavable by collagenase)
AGLGVVER, (SEQ ID NO: 132, cleavable by collagenase)
AGLGISST, (SEQ ID NO: 133, cleavable by collagenase)
EPQALAMS, (SEQ ID NO: 134, cleavable by collagenase)
QALAMSAI, (SEQ ID NO: 135, cleavable by collagenase)
AAYHLVSQ, (SEQ ID NO: 136, cleavable by collagenase)
MDAFLESS, (SEQ ID NO: 137, cleavable by collagenase)
ESLPVVAV, (SEQ ID NO: 138, cleavable by collagenase)
SAPAVESE, (SEQ ID NO: 139, cleavable by collagenase)
DVAQFVLT, (SEQ ID NO: 140, cleavable by collagenase)
VAQFVLTE, (SEQ ID NO: 141, cleavable by collagenase)
AQFVLTEG, (SEQ ID NO: 142, cleavable by collagenase)
PVQPIGPQ, (SEQ ID NO: 143, cleavable by thrombin)
LVPRGS,
and (SEQ ID NO: 345)
TSTSGRSANPRG.

In one embodiment of the present invention, a flexible linker is further attached to either one end or both ends of the protease cleavage sequence. The flexible linker at one end of the protease cleavage sequence can be referred to as a first flexible linker, and the flexible linker at the other end can be referred to as a second flexible linker. In a particular embodiment, the protease cleavage sequence and the flexible linker have any of the following formulas:

(protease cleavage sequence), (first flexible linker)-(protease cleavage sequence), (protease cleavage sequence)-(second flexible linker), and (first flexible linker)-(protease cleavage sequence)-(second flexible linker).

The flexible linker according to the present embodiment is preferably a peptide linker. The first flexible linker and the second flexible linker each independently and arbitrarily exist and are identical or different flexible linkers each containing at least one flexible amino acid (Gly, etc.). The flexible linker contains, for example, a sufficient number of residues (amino acids arbitrarily selected from Arg, Ile, Gln, Glu, Cys, Tyr, Trp, Thr, Val, His, Phe, Pro, Met, Lys, Gly, Ser, Asp, Asn, Ala, etc., particularly Gly, Ser, Asp, Asn, and Ala, in particular, Gly and Ser, especially Gly, etc.) for the protease cleavage sequence to obtain the desired protease accessibility.

The flexible linker suable for use at both ends of the protease cleavage sequence is usually a flexible linker that improves the access of protease to the protease cleavage sequence and elevates the cleavage efficiency of the protease. A suitable flexible linker may be readily selected and can be preferably selected from among different lengths such as 1 amino acid (Gly, etc.) to 20 amino acids, 2 amino acids to 15 amino acids, or 3 amino acids to 12 amino acids including 4 amino acids to 10 amino acids, 5 amino acids to 9 amino acids, 6 amino acids to 8 amino acids, or 7 amino acids to 8 amino acids. In some embodiments of the present invention, the flexible linker is a peptide linker of 1 to 7 amino acids.

Examples of the flexible linker include, but are not limited to, glycine polymers (G)n, glycine-serine polymers (including e.g., (GS)n, (GSGGS: SEQ ID NO: 45)n and (GGGS: SEQ ID NO: 36)n, wherein n is an integer of at least 1), glycine-alanine polymers, alanine-serine polymers, and other flexible linkers well known in conventional techniques.

Among them, glycine and glycine-serine polymers are receiving attention because these amino acids are relatively unstructured and easily function as neutral tethers between components.

Examples of the flexible linker consisting of the glycine-serine polymer can include, but are not limited to, Ser Gly·Ser(GS)

Ser·Gly(SG)

Gly·Gly·Ser(GGS)

Gly·Ser·Gly(GSG)

Ser·Gly·Gly(SGG)

Gly·Ser·Ser(GSS)

Ser·Ser·Gly(SSG)

Ser·Gly·Ser(SGS)

Gly·Gly·Gly·Ser(GGGS, SEQ ID NO: 36)

Gly·Gly·Ser·Gly(GGSG, SEQ ID NO: 37)

Gly·Ser·Gly·Gly(GSGG, SEQ ID NO: 38)

Ser·Gly·Gly·Gly(SGGG, SEQ ID NO: 39)

Gly·Ser·Ser·Gly(GSSG, SEQ ID NO: 40)

Gly·Gly·Gly·Gly·Ser(GGGGS, SEQ ID NO: 41)

Gly·Gly·Gly·Ser·Gly(GGGSG, SEQ ID NO: 42)

Gly·Gly·Ser·Gly·Gly(GGSGG, SEQ ID NO: 43)

Gly·Ser·Gly·Gly·Gly(GSGGG, SEQ ID NO: 44)

Gly·Ser·Gly·Gly·Ser(GSGGS, SEQ ID NO: 45)

Ser·Gly·Gly·Gly·Gly(SGGGG, SEQ ID NO: 46)

Gly·Ser·Ser·Gly·Gly(GSSGG, SEQ ID NO: 47)

Gly·Ser·Gly·Ser·Gly(GSGSG, SEQ ID NO: 48)

Ser·Gly·Gly·Ser·Gly(SGGSG, SEQ ID NO: 49)

Gly·Ser·Ser·Ser·Gly(GSSSG, SEQ ID NO: 50)

Gly·Gly·Gly·Gly·Gly·Ser(GGGGGS, SEQ ID NO: 51)

Ser·Gly·Gly·Gly·Gly·Gly(SGGGGG, SEQ ID NO: 52)

Gly·Gly·Gly·Gly·Gly·Gly·Ser
(GGGGGGS, SEQ ID NO: 53)

Ser·Gly·Gly·Gly·Gly·Gly·Gly
(SGGGGGG, SEQ ID NO: 54)

(Gly·Gly·Gly·Gly·Ser(GGGGS, SEQ ID NO: 41))n (Ser·Gly·Gly·Gly·Gly(SGGGG, SEQ ID NO: 46))n wherein n is an integer of 1 or larger.

However, the length and sequence of the peptide linker can be appropriately selected by those skilled in the art according to the purpose.

In some embodiments of the present invention, the ligand binding molecule comprises antibody VH and antibody VL. Examples of the ligand binding molecule comprising VH and VL include, but are not limited to, Fv, scFv, Fab, Fab', Fab'-SH, F(ab')$_2$, and complete antibodies.

In some embodiments of the present invention, the ligand binding molecule contains a Fc region. In the case of using an IgG antibody Fc region, its type is not limited, and, for example, IgG1, IgG2, IgG3, or IgG4 Fc region may be used.

For example, a Fc region containing one sequence selected from the amino acid sequences represented by SEQ ID NOs: 55, 56, 57, and 58, or a Fc region mutant prepared by adding an alteration to the Fc region may be used. In some embodiments of the present invention, the ligand binding molecule comprises an antibody constant region.

In some more specific embodiments of the present invention, the ligand binding molecule is an antibody. In the case of using an antibody as the ligand binding molecule, the binding to the ligand is achieved by a variable region. In some further specific embodiments, the ligand binding molecule is an IgG antibody. In the case of using an IgG antibody as the ligand binding molecule, its type is not limited, and IgG1, IgG2, IgG3, IgG4, or the like can be used. In the case of using an IgG antibody as the ligand binding molecule, the binding to the ligand is also achieved by a variable region. One or both of the two variable regions of the IgG antibody can achieve the binding to the ligand.

In some embodiments of the present invention, a domain having ligand binding activity is separated from the ligand binding molecule by the cleavage of the cleavage site or the protease cleavage sequence in the ligand binding molecule so that the binding to the ligand is attenuated. In an embodiment using an IgG antibody as the ligand binding molecule, for example, the cleavage site or the protease cleavage sequence is established in an antibody variable region, and a complete antibody variable region cannot be formed in a cleaved state so that the binding to the ligand is attenuated.

In the present specification, the "association" can refer to, for example, a state where two or more polypeptide regions interact with each other. In general, a hydrophobic bond, a hydrogen bond, an ionic bond, or the like is formed between the intended polypeptide regions to form an associate. As one example of common association, an antibody typified by a natural antibody is known to retain a paired structure of a heavy chain variable region (VH) and a light chain variable region (VL) through a noncovalent bond or the like therebetween.

In some embodiments of the present invention, VH and VL contained in the ligand binding molecule associate with each other. The association between the antibody VH and the antibody VL may be canceled, for example, by the cleavage of the cleavage site or the protease cleavage sequence. The cancelation of the association can be used interchangeably with, for example, the whole or partial cancelation of the state where two or more polypeptide regions interact with each other. For the cancelation of the association between the VH and the VL, the interaction between the VH and the VL may be wholly canceled, or the interaction between the VH and the VL may be partially canceled.

The ligand binding molecule of the present invention encompasses a ligand binding molecule in which the association between antibody VL or a portion thereof and antibody VH or a portion thereof is canceled by the cleavage of the cleavage site or canceled by the protease cleavage of the protease cleavage sequence.

In some embodiments of the present invention, the ligand binding molecule comprises antibody VH and antibody VL, and the antibody VH and the antibody VL in the ligand binding molecule are associated with each other in a state where the cleavage site or the protease cleavage sequence of the ligand binding molecule is uncleaved, whereas the association between the antibody VH and the antibody VL in the ligand binding molecule is canceled by the cleavage of the cleavage site or the protease cleavage sequence. The cleavage site or the protease cleavage sequence in the ligand binding molecule may be placed at any position in the ligand binding molecule as long as the ligand binding of the ligand binding molecule can be attenuated by the cleavage of the cleavage site or the protease cleavage sequence.

In some embodiments of the present invention, the ligand binding molecule comprises antibody VH, antibody VL, and an antibody constant region.

As mentioned by Rothlisberger et al. (J Mol Biol. 2005 Apr. 8; 347 (4): 773-89), it is known that the VH and VL domains or the CH and CL domains of an antibody interact with each other via many amino acid side chains. VH-CH1 and VL-CL are known to be capable of forming a stable structure as a Fab domain. As previously reported, amino acid side chains generally interact between VH and VL with a dissociation constant in the range of $10^{-5}$ M to $10^{-8}$ M. When only VH and VL domains exist, only a small proportion may form an associated state.

In some embodiments of the present invention, the ligand binding molecule is designed such that the cleavage site or the protease cleavage sequence is established in the ligand binding molecule comprising antibody VH and antibody VL, and the entire heavy chain-light chain interaction is present between two peptides in the Fab structure before cleavage, whereas the interaction between the peptide containing the VH (or a portion of the VH) and the peptide containing the VL (or a portion of the VL) is attenuated by the cleavage of the cleavage site or the protease cleavage sequence so that the association between the VH and the VL is canceled.

In one embodiment of the present invention, the cleavage site or the protease cleavage sequence is located within the antibody constant region. In a more specific embodiment, the cleavage site or the protease cleavage sequence is located on the variable region side with respect to amino acid position 140 (EU numbering) in an antibody heavy chain constant region, preferably on the variable region side with respect to amino acid position 122 (EU numbering) in an antibody heavy chain constant region. In some specific embodiments, the cleavage site or the protease cleavage sequence is inserted at any position in a sequence from antibody heavy chain constant region amino acid position 118 (EU numbering) to antibody heavy chain constant region amino acid position 140 (EU numbering). In another more specific embodiment, the cleavage site or the protease cleavage sequence is located on the variable region side with respect to amino acid position 130 (EU numbering) (Kabat numbering position 130) in an antibody light chain constant region, preferably on the variable region side with respect to amino acid position 113 (EU numbering) (Kabat numbering position 113) in an antibody light chain constant region or on the variable region side with respect to amino acid position 112 (EU numbering) (Kabat numbering position 112) in an antibody light chain constant region. In some specific embodiments, the cleavage site or the protease cleavage sequence is inserted at any position in a sequence from antibody light chain constant region amino acid position 108 (EU numbering) (Kabat numbering position 108) to antibody light chain constant region amino acid position 131 (EU numbering) (Kabat numbering position 131).

In one embodiment of the present invention, the cleavage site or the protease cleavage sequence is located within the antibody VH or within the antibody VL. In a more specific embodiment, the cleavage site or the protease cleavage sequence is located on the antibody constant region side with respect to amino acid position 7 (Kabat numbering) of the antibody VH, preferably on the antibody constant region side with respect to amino acid position 40 (Kabat numbering) of the antibody VH, more preferably on the antibody constant region side with respect to amino acid position 101 (Kabat numbering) of the antibody VH, further preferably on the antibody constant region side with respect to amino acid position 109 (Kabat numbering) of the antibody VH or on the antibody constant region side with respect to amino acid position 111 (Kabat numbering) of the antibody VH. In a more specific embodiment, the cleavage site or the protease cleavage sequence is located on the antibody constant region side with respect to amino acid position 7 (Kabat numbering) of the antibody VL, preferably on the antibody constant region side with respect to amino acid position 39 (Kabat numbering) of the antibody VL, more preferably on the antibody constant region side with respect to amino acid position 96 (Kabat numbering) of the antibody VL, further preferably on the antibody constant region side with respect to amino acid position 104 (Kabat numbering) of the antibody VL or on the antibody constant region side with respect to amino acid position 105 (Kabat numbering) of the antibody VL.

In some more specific embodiments, the cleavage site or the protease cleavage sequence is inserted at a position of residues constituting a loop structure in the antibody VH or the antibody VL, and residues close to the loop structure. The loop structure in the antibody VH or the antibody VL refers to a moiety that does not form a secondary structure such as α-helix or n-sheet, in the antibody VH or the antibody VL. Specifically, the position of the residues constituting the loop structure and the residues close to the loop structure can refer to the range of amino acid position 7 (Kabat numbering) to amino acid position 16 (Kabat numbering), amino acid position 40 (Kabat numbering) to amino acid position 47 (Kabat numbering), amino acid position 55 (Kabat numbering) to amino acid position 69 (Kabat numbering), amino acid position 73 (Kabat numbering) to amino acid position 79 (Kabat numbering), amino acid position 83 (Kabat numbering) to amino acid position 89 (Kabat numbering), amino acid position 95 (Kabat numbering) to amino acid position 99 (Kabat numbering), or amino acid position 101 (Kabat numbering) to amino acid position 113 (Kabat numbering) of the antibody VH, or amino acid position 7 (Kabat numbering) to amino acid position 19 (Kabat numbering), amino acid position 39 (Kabat numbering) to amino acid position 46 (Kabat numbering), amino acid position 49 (Kabat numbering) to amino acid position 62 (Kabat numbering), or amino acid position 96 (Kabat numbering) to amino acid position 107 (Kabat numbering) of the antibody VL.

In some more specific embodiments, the cleavage site or the protease cleavage sequence is inserted at any position in a sequence from amino acid position 7 (Kabat numbering) to amino acid position 16 (Kabat numbering), from amino acid position 40 (Kabat numbering) to amino acid position 47 (Kabat numbering), from amino acid position 55 (Kabat numbering) to amino acid position 69 (Kabat numbering), from amino acid position 73 (Kabat numbering) to amino acid position 79 (Kabat numbering), from amino acid position 83 (Kabat numbering) to amino acid position 89 (Kabat numbering), from amino acid position 95 (Kabat numbering) to amino acid position 99 (Kabat numbering), or from amino acid position 101 (Kabat numbering) to amino acid position 113 (Kabat numbering) of the antibody VH.

In some more specific embodiments, the cleavage site or the protease cleavage sequence is inserted at any position in a sequence from amino acid position 7 (Kabat numbering) to amino acid position 19 (Kabat numbering), from amino acid position 39 (Kabat numbering) to amino acid position 46 (Kabat numbering), from amino acid position 49 (Kabat numbering) to amino acid position 62 (Kabat numbering), or from amino acid position 96 (Kabat numbering) to amino acid position 107 (Kabat numbering) of the antibody VL.

In one embodiment of the present invention, the cleavage site or the protease cleavage sequence is located near the boundary between the antibody VH and the antibody constant region. The phrase "near the boundary between the antibody VH and the antibody heavy chain constant region" can refer to between amino acid position 101 (Kabat numbering) of the antibody VH and amino acid position 140 (EU numbering) of the antibody heavy chain constant region and can preferably refer to between amino acid position 109 (Kabat numbering) of the antibody VH and amino acid position 122 (EU numbering) of the antibody heavy chain constant region, or between amino acid position 111 (Kabat numbering) of the antibody VH and amino acid position 122 (EU numbering) of the antibody heavy chain constant region. When antibody VH is fused with an antibody light chain constant region, the phrase "near the boundary between the antibody VH and the antibody light chain constant region" can refer to between amino acid position 101 (Kabat numbering) of the antibody VH and amino acid position 130 (EU numbering) (Kabat numbering position 130) of the antibody light chain constant region and can preferably refer to between amino acid position 109 (Kabat numbering) of the antibody VH and amino acid position 113 (EU numbering) (Kabat numbering position 113) of the antibody light chain constant region, or between amino acid position 111 (Kabat numbering) of the antibody VH and amino acid position 112 (EU numbering) (Kabat numbering position 112) of the antibody light chain constant region.

In one embodiment, the cleavage site or the protease cleavage sequence is located near the boundary between the antibody VL and the antibody constant region. The phrase "near the boundary between the antibody VL and the antibody light chain constant region" can refer to between amino acid position 96 (Kabat numbering) of the antibody VL and amino acid position 130 (EU numbering) (Kabat numbering position 130) of the antibody light chain constant region and can preferably refer to between amino acid position 104 (Kabat numbering) of the antibody VL and amino acid position 113 (EU numbering) (Kabat numbering position 113) of the antibody light chain constant region, or between amino acid position 105 (Kabat numbering) of the antibody VL and amino acid position 112 (EU numbering) (Kabat numbering position 112) of the antibody light chain constant region. When antibody VL is fused with an antibody heavy chain constant region, the phrase "near the boundary between the antibody VL and the antibody heavy chain constant region" can refer to between amino acid position 96 (Kabat numbering) of the antibody VL and amino acid position 140 (EU numbering) of the antibody heavy chain constant region and can preferably refer to between amino acid position 104 (Kabat numbering) of the antibody VL and amino acid position 122 (EU numbering) of the antibody heavy chain constant region, or between amino acid position 105 (Kabat numbering) of the antibody VL and amino acid position 122 (EU numbering) of the antibody heavy chain constant region.

The cleavage site or the protease cleavage sequence can be established at a plurality of positions in the ligand binding molecule and can be established at a plurality of positions selected from, for example, within the antibody constant region, within the antibody VH, within the antibody VL, near the boundary between the antibody VH and the antibody constant region, and near the boundary between antibody VL and the antibody constant region. Those skilled in the art with reference to the present invention can change the form of a molecule comprising antibody VH, antibody VL, and an antibody constant region, for example, by swapping the antibody VH with the antibody VL. Such a molecular form is included in the scope of the present invention.

In the present specification, the term "ligand" is a molecule having biological activity. The molecule having biological activity usually functions by interacting with a receptor on cell surface and thereby performing biological stimulation, inhibition, or modulation in other modes. These functions are usually thought to participate in the intracellular signaling pathways of cells carrying the receptor.

In the present specification, the ligand encompasses the desired molecule that exerts biological activity through interaction with a biomolecule. For example, the ligand not only means a molecule that interacts with a receptor but also includes a molecule that exerts biological activity through interaction with the molecule, for example, a receptor that interacts with the molecule, or a binding fragment thereof. For example, a ligand binding site of a protein known as a receptor, and a protein containing an interaction site of the receptor with another molecule are included in the ligand according to the present invention. Specifically, for example, a soluble receptor, a soluble fragment of a receptor, an extracellular domain of a transmembrane receptor, and polypeptides containing them are included in the ligand according to the present invention.

The ligand of the present invention can usually exert desirable biological activity by binding to one or more binding partners. The binding partner of the ligand can be an extracellular, intracellular, or transmembrane protein. In one embodiment, the binding partner of the ligand is an extracellular protein, for example, a soluble receptor. In another embodiment, the binding partner of the ligand is a membrane-bound receptor.

The ligand of the present invention can specifically bind to the binding partner with a dissociation constant (KD) of 10 µM, 1 µM, 100 nM, 50 nM, 10 nM, 5 nM, 1 nM, 500 pM, 400 pM, 350 pM, 300 pM, 250 pM, 200 pM, 150 pM, 100 pM, 50 pM, 25 pM, 10 pM, 5 pM, 1 pM, 0.5 pM, or 0.1 pM or less.

Examples of the molecule having biological activity include, but are not limited to, cytokines, chemokines, polypeptide hormones, growth factors, apoptosis inducing factors, PAMPs, DAMPs, nucleic acids, and fragments thereof. In a specific embodiment, an interleukin, an interferon, a hematopoietic factor, a member of the TNF superfamily, a chemokine, a cell growth factor, a member of the TGF-β family, a myokine, an adipokine, or a neurotrophic factor can be used as the ligand. In a more specific embodiment, CXCL10, IL-2, IL-7, IL-12, IL-15, IL-18, IL-21, IFN-α, IFN-β, IFN-g, MIG, I-TAC, RANTES, MIP-1a, or MIP-1b can be used as the ligand.

Chemokines are a homogeneous serum protein family of 7 to 16 kDa originally characterized by their ability to induce leukocyte migration. Most of chemokines have four characteristic cysteines (Cys) and are classified into CXC or alpha, CC or beta, C or gamma and CX3C or delta chemokine classes according to motifs formed by the first two cysteines. Two disulfide bonds are formed between the first and third cysteines and between the second and fourth cysteines. In general, the disulfide bridges are considered necessary. Clark-Lewis and collaborators have reported that the disulfide bonds are crucial for the chemokine activity of at least CXCL10 (Clark-Lewis et al., J. Biol. Chem. 269: 16075-16081, 1994). The only one exception to having four cysteines is lymphotactin, which has only two cysteine residues. Thus, lymphotactin narrowly maintains its functional structure by only one disulfide bond.

Subfamilies of CXC or alpha are further classified, according to the presence of an ELR motif (Glu-Leu-Arg) preceding the first cysteine, into two groups: ELR-CXC chemokines and non-ELR-CXC chemokines (see e.g., Clark-Lewis, supra; and Belperio et al., "CXC Chemokines in Angiogenesis", J. Leukoc. Biol. 68: 1-8, 2000).

Interferon-inducible protein-10 (IP-10 or CXCL10) is induced by interferon-γ and TNF-α and produced by keratinocytes, endothelial cells, fibroblasts and monocytes. IP-10 is considered to play a role in mobilizing activated T cells to an inflammatory site of a tissue (Dufour, et al., "IFN-gamma-inducible protein 10 (IP-10; CXCL10)-deficient mice reveal a role for IP-10 in effector T cell generation and trafficking", J Immunol., 168: 3195-204, 2002). Furthermore, there is a possibility that IP-10 plays a role in hypersensitive reaction. There is a possibility that IP-10 also plays a role in the occurrence of inflammatory demyelinating neuropathies (Kieseier, et al., "Chemokines and chemokine receptors in inflammatory demyelinating neuropathies: a central role for IP-10", Brain 125: 823-34, 2002).

Research indicates the possibility that IP-10 is useful in the engraftment of stem cells following transplantation (Nagasawa, T., Int. J. Hematol. 72: 408-11, 2000), the mobilization of stem cells (Gazitt, Y., J. Hematother Stem Cell Res 10: 229-36, 2001; and Hattori et al., Blood 97: 3354-59, 2001) and antitumor hyperimmunity (Nomura et al., Int. J. Cancer 91: 597-606, 2001; and Mach and Dranoff, Curr. Opin. Immunol. 12: 571-75, 2000). For example, previous reports known to those skilled in the art discuss the biological activity of chemokine (Bruce, L. et al., "Radiolabeled Chemokine binding assays", Methods in Molecular Biology (2000) vol. 138, pp. 129-134; Raphaele, B. et al., "Calcium Mobilization", Methods in Molecular Biology (2000) vol. 138, pp. 143-148; and Paul D. Ponath et al., "Transwell Chemotaxis", Methods in Molecular Biology (2000) vol. 138, pp. 113-120 Humana Press. Totowa, New Jersey).

Examples of the biological activity of CXCL10 include binding to a CXCL10 receptor (CXCR3), CXCL10-induced calcium flux, CXCL10-induced cell chemotaxis, binding of CXCL10 to glycosaminoglycan and CXCL10 oligomerization.

Examples of the method for measuring the physiological activity of CXCL10 include a method of measuring the cell chemotactic activity of CXCL10, reporter assay using a cell line stably expressing CXCR3 (see PLoS One. 2010 Sep. 13; 5 (9): e12700), and PathHunter™ β-Arrestin recruitment assay using B-arrestin recruitment induced at the early stage of GPCR signal transduction.

Interleukin 12 (IL-12) is a heterodimeric cytokine consisting of disulfide-linked glycosylated polypeptide chains of 30 and 40 kD. Cytokines are synthesized and then secreted by dendritic cells, monocytes, macrophages, B cells, Langerhans cells and keratinocytes, and antigen-presenting cells including natural killer (NK) cells. IL-12 mediates various biological processes and has been mentioned as a NK cell stimulatory factor (NKSF), a T cell stimulatory factor, a cytotoxic T lymphocyte maturation factor and an EBV-transformed B cell line factor.

Interleukin 12 can bind to an IL-12 receptor expressed on the cytoplasmic membranes of cells (e.g., T cells and NK cells) and thereby change (e.g., start or block) a biological process. For example, the binding of IL-12 to an IL-12 receptor stimulates the growth of preactivated T cells and NK cells, promotes the cytolytic activity of cytotoxic T cells (CTL), NK cells and LAK (lymphokine-activated killer) cells, induces the production of γ interferon (IFNγ) by T cells and NK cells, and induces the differentiation of naive Th0 cells into Th1 cells producing IFNγ and IL-2. In particular, IL-12 is absolutely necessary for setting the production and cellular immune response (e.g., Th1 cell-mediated immune response) of cytolytic cells (e.g., NK and CTL). Thus, IL-12 is absolutely necessary for generating and regulating both protective immunity (e.g., eradication of infectious disease) and pathological immune response (e.g., autoimmunity).

Examples of the method for measuring the physiological activity of IL12 include a method of measuring the cell growth activity of IL12, STAT4 reporter assay, a method of measuring cell activation (cell surface marker expression, cytokine production, etc.) by IL12, and a method of measuring the promotion of cell differentiation by IL12.

Programmed death 1 (PD-1) protein is an inhibitory member of the CD28 family of receptors. The CD28 family also includes CD28, CTLA-4, ICOS and BTLA. PD-1 is expressed on activated B cells, T cells and bone marrow cells (Okazaki et al., (2002) Curr. Opin. Immunol. 14: 391779-82; and Bennett et al., (2003) J Immunol 170: 711-8). CD28 and ICOS, the initial members of the family, were discovered on the basis of functional influence on the elevation of T cell growth after monoclonal antibody addition (Hutloff et al., (1999) Nature 397: 263-266; and Hansen et al., (1980) Immunogenics 10: 247-260). PD-1 was discovered by screening for differential expression in apoptotic cells (Ishida et al., (1992) EMBO J 11: 3887-95). CTLA-4 and BTLA, the other members of the family, were discovered by screening for differential expression in cytotoxic T lymphocytes and TH1 cells, respectively. CD28, ICOS and CTLA-4 all have an unpaired cysteine residue which permits homodimerization. In contrast, PD-1 is considered to exist as a monomer and lacks the unpaired cysteine residue characteristic of other members of the CD28 family.

The PD-1 gene encodes a 55 kDa type I transmembrane protein which is part of the Ig superfamily. PD-1 contains a membrane-proximal immunoreceptor tyrosine inhibitory motif (ITIM) and a membrane-distal tyrosine-based switch motif (ITSM). PD-1 is structurally similar to CTLA-4, but lacks a MYPPPY motif (SEQ ID NO: 537) important for B7-1 and B7-2 binding. Two ligands, PD-L1 and PD-L2, for PD-1 have been identified and have been shown to negatively regulate T-cell activation upon binding to PD-1 (Freeman et al., (2000) J Exp Med 192: 1027-34; Latchman et al., (2001) Nat Immunol 2: 261-8; and Carter et al., (2002) Eur J Immunol 32: 634-43). Both PD-L1 and PD-L2 are B7 homologs that bind to PD-1, but do not bind to the other members of the CD28 family. PD-L1, one of the PD-1 ligands, is abundant in various human cancers (Dong et al., (2002) Nat. Med. 8: 787-9). The interaction between PD-1 and PD-L1 results in decrease in tumor-infiltrating lymphocytes, reduction in T cell receptor-mediated growth, and immune evasion by the cancerous cells (Dong et al., (2003) J. Mol. Med. 81: 281-7; Blank et al., (2005) Cancer Immunol. Immunother. 54: 307-314; and Konishi et al., (2004) Clin. Cancer Res. 10: 5094-100). Immunosuppression can be reversed by inhibiting the local interaction of PD-1 with PD-L1, and this effect is additive when the interaction of PD-2 with PD-L2 is also inhibited (Iwai et al., (2002) Proc. Natl. Acad. Sci. USA 99: 12293-7; and Brown et al., (2003) J. Immunol. 170: 1257-66).

PD-1 is an inhibitory member of the CD28 family expressed on activated B cells, T-cells, and bone marrow cells. Animals deficient in PD-1 develop various autoimmune phenotypes, including autoimmune cardiomyopathy and lupus-like syndrome with arthritis and nephritis (Nishimura et al., (1999) Immunity 11: 141-51; and Nishimura et al., (2001) Science 291: 319-22). PD-1 has been further found to play an important role in autoimmune encephalomyelitis, systemic lupus erythematosus, graft-versus-host disease (GVHD), type I diabetes mellitus, and rheumatoid arthritis (Salama et al., (2003) J Exp Med 198: 71-78; Prokunia and Alarcon-Riquelme (2004) Hum Mol Genet 13: R143; and Nielsen et al., (2004) Lupus 13: 510). In a mouse B cell tumor line, the ITSM of PD-1 has been shown to be essential for inhibiting BCR-mediated $Ca^{2+}$ flux and tyrosine phosphorylation of downstream effector molecules (Okazaki et al., (2001) PNAS 98: 13866-71).

In some embodiments of the present invention, the ligand is a cytokine.

Cytokines are a secreted cell signaling protein family involved in immunomodulatory and inflammatory processes. These cytokines are secreted by glial cells of the nervous system and by many cells of the immune system. The cytokines can be classified into proteins, peptides and glycoproteins and encompass large diverse regulator families. The cytokines can induce intracellular signal transduction through binding to their cell surface receptors, thereby causing the regulation of enzyme activity, upregulation or downregulation of some genes and transcriptional factors thereof, or feedback inhibition, etc.

In some embodiments, the cytokine of the present invention includes immunomodulatory factors such as interleukins (IL) and interferons (IFN). A suitable cytokine can contain a protein derived from one or more of the following types: four α-helix bundle families (which include the IL-2 subfamily, the IFN subfamily and IL-10 subfamily); the IL-1 family (which includes IL-1 and IL-8); and the IL-17 family. The cytokine can also include those classified into type 1 cytokines (e.g., IFN-γ and TGF-β) which enhance cellular immune response, or type 2 cytokines (e.g., IL-4, IL-10, and IL-13) which work advantageously for antibody reaction.

In some embodiments of the present invention, the ligand is a chemokine.

Chemokines generally act as chemoattractants that mobilize immune effector cells to chemokine expression sites. This is considered beneficial for expressing a particular chemokine gene, for example, together with a cytokine gene, for the purpose of mobilizing other immune system components to a treatment site. Such chemokines include CXCL10, RANTES, MCAF, MIP1-α, and MIP1-β. Those skilled in the art should know that certain cytokines also have a chemoattractive effect and acknowledge that such cytokines can be classified by the term "chemokine".

In some embodiments of the present invention, a cytokine variant, a chemokine variant, or the like (e.g., Annu Rev Immunol. 2015; 33: 139-67) or a fusion protein containing the variants (e.g., Stem Cells Transl Med. 2015 January; 4 (1): 66-73) can be used as the ligand.

In some embodiments of the present invention, the ligand is selected from CXCL10, PD1, IL12, and IL6R. The CXCL10, the PD1, the IL12, or the IL6R may have the same sequence as that of naturally occurring CXCL10, PD1, IL12, or IL6R or may be an ligand variant that differs in sequence from naturally occurring CXCL10, PD1, IL12, or IL6R, but retains the physiological activity of the corresponding natural ligand. In order to obtain the ligand variant, an alteration may be artificially added to the ligand sequence for various purposes. Preferably, an alteration to resist protease cleavage (protease resistance alteration) is added thereto to obtain a ligand variant.

In some embodiments of the present invention, the biological activity of the ligand is inhibited by binding to the uncleaved ligand binding molecule. Examples of the embodiments in which the biological activity of the ligand is inhibited include, but are not limited to, embodiments in which the binding of the ligand to the uncleaved ligand binding molecule substantially or significantly interferes or competes with the binding of the ligand to its binding partner. In the case of using an antibody or a fragment thereof having ligand neutralizing activity as the ligand binding molecule, the ligand binding molecule bound with the ligand is capable of inhibiting the biological activity of the ligand by exerting its neutralizing activity.

In one embodiment of the present invention, preferably, the uncleaved ligand binding molecule can sufficiently neutralize the biological activity of the ligand by binding to the ligand. Specifically, the biological activity of the ligand bound with the uncleaved ligand binding molecule is preferably lower than that of the ligand unbound with the uncleaved ligand binding molecule. The biological activity of the ligand bound with the uncleaved ligand binding molecule can be, for example, 90% or less, preferably 80% or less, 70% or less, 60% or less, 50% or less, 40% or less, or 30% or less, particularly preferably 20% or less, 10% or less, 9% or less, 8% or less, 7% or less, 6% or less, 5% or less, 4% or less, 3% or less, 2% or less, or 1% or less, of the biological activity of the ligand unbound with the uncleaved ligand binding molecule, though not limited thereto. The administration of the ligand binding molecule, which sufficiently neutralizes the biological activity of the ligand, can be expected to prevent the ligand from exerting its biological activity before arriving at a target tissue.

In one embodiment of the present invention, the binding activity of the cleaved ligand binding molecule against the ligand is preferably lower than that of an in vivo natural ligand binding partner (e.g., natural receptor for the ligand) against the ligand. The binding activity of the cleaved ligand binding molecule against the ligand exhibits, for example, 90% or less, preferably 80% or less, 70% or less, 60% or less, 50% or less, 40% or less, or 30% or less, particularly preferably 20% or less, 10% or less, 9% or less, 8% or less, 7% or less, 6% or less, 5% or less, 4% or less, 3% or less, 2% or less, or 1% or less, of the amount of the ligand bound with the in vivo natural binding partner (per unit binding partner), though not limited thereto. The desired index may be appropriately used as an index for binding activity. For example, a dissociation constant (KD) may be used. In the case of using a dissociation constant (KD) as an index for evaluating binding activity, a larger dissociation constant (KD) of the cleaved ligand binding molecule for the ligand than that of the in vivo natural binding partner for the ligand means that the cleaved ligand binding molecule has weaker binding activity against the ligand than that of the in vivo natural binding partner. The dissociation constant (KD) of the cleaved ligand binding molecule for the ligand is, for example, at least 1.1 times, preferably at least 1.5 times, at least 2 times, at least 5 times, or at least 10 times, particularly preferably at least 100 times the dissociation constant (KD) of the in vivo natural binding partner for the ligand. The ligand binding molecule having only low binding activity against the ligand or hardly having binding activity against the ligand after cleavage guarantees that the ligand is released by the cleavage of the ligand binding molecule, and can be expected to be prevented from binding to another ligand molecule again.

The ligand desirably restores the suppressed biological activity after cleavage of the ligand binding molecule. Desirably, the ligand binding of the cleaved ligand binding molecule is attenuated so that the ligand biological activity-inhibiting function of the ligand binding molecule is also attenuated. Those skilled in the art can confirm the biological activity of the ligand by a known method, for example, a method of detecting the binding of the ligand to its binding partner.

In some embodiments of the present invention, the uncleaved ligand binding molecule forms a complex with the ligand through antigen-antibody binding. In a more specific embodiment, the complex of the ligand binding molecule and the ligand is formed through a noncovalent bond, for example, antigen-antibody binding, between the ligand binding molecule and the ligand.

In some embodiments of the present invention, the uncleaved ligand binding molecule is fused with the ligand to form a fusion protein. The ligand binding molecule moiety and the ligand moiety in the fusion protein further interact with each other through antigen-antibody binding. The ligand binding molecule and the ligand can be fused via a linker or without a linker. Even when the ligand binding molecule and the ligand in the fusion protein are fused via or without a linker, the noncovalent bond still exists between the ligand binding molecule moiety and the ligand moiety. In other words, even in the embodiments in which the ligand binding molecule is fused with the ligand, the noncovalent bond between the ligand binding molecule moiety and the ligand moiety is similar to that in embodiments in which the ligand binding molecule is not fused with the ligand. The noncovalent bond is attenuated by the cleavage of the ligand binding molecule. In short, the ligand binding of the ligand binding molecule is attenuated.

In a preferred embodiment of the present invention, the ligand binding molecule and the ligand are fused via a linker. For example, an arbitrary peptide linker that can be introduced by genetic engineering, or a linker disclosed as a synthetic compound linker (see e.g., Protein Engineering, 9 (3), 299-305, 1996) can be used as the linker in the fusion of the ligand binding molecule with the ligand. In the present embodiment, a peptide linker is preferred. The length of the peptide linker is not particularly limited and may be appropriately selected by those skilled in the art according to the purpose. Examples of the peptide linker can include, but are not limited to:

```
Ser

Gly•Ser(GS)

Ser•Gly(SG)

Gly•Gly•Ser(GGS)

Gly•Ser•Gly(GSG)

Ser•Gly•Gly(SGG)

Gly•Ser•Ser(GSS)

Ser•Ser•Gly(SSG)

Ser•Gly•Ser(SGS)

Gly•Gly•Gly•Ser(GGGS, SEQ ID NO: 36)

Gly•Gly•Ser•Gly(GGSG, SEQ ID NO: 37)

Gly•Ser•Gly•Gly(GSGG, SEQ ID NO: 38)

Ser•Gly•Gly•Gly(SGGG, SEQ ID NO: 39)
```

-continued

```
Gly•Ser•Ser•Gly(GSSG, SEQ ID NO: 40)

Gly•Gly•Gly•Gly•Ser(GGGGS, SEQ ID NO: 41)

Gly•Gly•Gly•Ser•Gly(GGGSG, SEQ ID NO: 42)

Gly•Gly•Ser•Gly•Gly(GGSGG, SEQ ID NO: 43)

Gly•Ser•Gly•Gly•Gly(GSGGG, SEQ ID NO: 44)

Gly•Ser•Gly•Gly•Ser(GSGGS, SEQ ID NO: 45)

Ser•Gly•Gly•Gly•Gly(SGGGG, SEQ ID NO: 46)

Gly•Ser•Ser•Gly•Gly(GSSGG, SEQ ID NO: 47)

Gly•Ser•Gly•Ser•Gly(GSGSG, SEQ ID NO: 48)

Ser•Gly•Gly•Ser•Gly(SGGSG, SEQ ID NO: 49)

Gly•Ser•Ser•Ser•Gly(GSSSG, SEQ ID NO: 50)

Gly•Gly•Gly•Gly•Gly•Ser(GGGGGS, SEQ ID NO: 51)

Ser•Gly•Gly•Gly•Gly•Gly(SGGGGG, SEQ ID NO: 52)

Gly•Gly•Gly•Gly•Gly•Gly•Ser
(GGGGGGS, SEQ ID NO: 53)

Ser•Gly•Gly•Gly•Gly•Gly•Gly
(SGGGGGG, SEQ ID NO: 54)

(Gly•Gly•Gly•Gly•Ser(GGGGS, SEQ ID NO: 41))n (Ser•Gly•Gly•Gly•Gly(SGGGG, SEQ ID NO: 46))n
``` wherein n is an integer of 1 or larger.

However, the length and sequence of the peptide linker can be appropriately selected by those skilled in the art according to the purpose.

The synthetic compound linker (chemical cross-linking agent) is a cross-linking agent usually used in peptide cross-linking, for example, N-hydroxysuccinimide (NHS), disuccinimidyl suberate (DSS), bis(sulfosuccinimidyl) suberate (BS3), dithiobis(succinimidyl propionate) (DSP), dithiobis(sulfosuccinimidyl propionate) (DTSSP), ethylene glycol bis(succinimidyl succinate) (EGS), ethylene glycol bis(sulfosuccinimidyl succinate) (sulfo-EGS), disuccinimidyl tartrate (DST), disulfosuccinimidyl tartrate (sulfo-DST), bis[2-(succinimidoxycarbonyloxy)ethyl]sulfone (BSOCOES), or bis[2-(sulfosuccinimidoxycarbonyloxy)ethyl]sulfone (sulfo-BSOCOES).

These cross-linking agents are commercially available.

The present invention also relates to a pharmaceutical composition (drug) comprising the ligand binding molecule of the present invention and a pharmaceutically acceptable carrier, a pharmaceutical composition (drug) comprising the ligand binding molecule of the present invention, a ligand, and a pharmaceutically acceptable carrier, and a pharmaceutical composition (drug) comprising a fusion protein of the ligand binding molecule of the present invention fused with a ligand, and a pharmaceutically acceptable carrier.

The "treatment" (and its grammatically derived words, for example, "treat" and "treating") used in the present specification means clinical intervention that intends to alter the natural course of an individual to be treated and can be carried out both for prevention and during the course of a clinical pathological condition. The desirable effect of the treatment includes, but is not limited to, the prevention of the development or recurrence of a disease, the alleviation of symptoms, the attenuation of any direct or indirect pathological influence of the disease, the prevention of metastasis, reduction in the rate of progression of the disease, recovery from or alleviation of a disease condition, and ameliorated or improved prognosis. In some embodiments, the ligand binding molecule of the present invention can control the biological activity of the ligand and is used for delaying the onset of a disease or delaying the progression of the disease.

In the present invention, the pharmaceutical composition usually refers to a drug for the treatment or prevention of a disease or for examination or diagnosis.

In the present invention, the term "pharmaceutical composition comprising the ligand binding molecule" may be used interchangeably with a "method for treating a disease, comprising administering the ligand binding molecule to a subject to be treated" and may be used interchangeably with "use of the ligand binding molecule for the production of a drug for the treatment of a disease". Also, the term "pharmaceutical composition comprising the ligand binding molecule" may be used interchangeably with "use of the ligand binding molecule for treating a disease".

The term "pharmaceutical composition comprising the ligand binding molecule and a ligand" may be used interchangeably with a "method for treating a disease, comprising administering the ligand binding molecule and a ligand to a subject to be treated" and may be used interchangeably with "use of the ligand binding molecule and a ligand for the production of a drug for the treatment of a disease". Also, the term "pharmaceutical composition comprising the ligand binding molecule and a ligand" may be used interchangeably with "use of the ligand binding molecule and a ligand for treating a disease".

The term "pharmaceutical composition comprising a fusion protein" may be used interchangeably with a "method for treating a disease, comprising administering a fusion protein to a subject to be treated" and may be used interchangeably with "use of a fusion protein for the production of a drug for the treatment of a disease". Also, the term "pharmaceutical composition comprising a fusion protein" may be used interchangeably with "use of a fusion protein for treating a disease".

In some embodiments of the present invention, a composition containing the ligand binding molecule can be administered to an individual. The ligand binding molecule administered to an individual binds to a ligand originally present in the individual, for example, in blood or in a tissue, and the ligand binding molecule in this state bound with the ligand is further transported in vivo. The ligand binding molecule transported to a target tissue can be cleaved in the target tissue so that its binding to the ligand can be attenuated to release the bound ligand in the target tissue. The released ligand can exert biological activity in the target tissue and treat a disease caused by the target tissue. In the embodiments in which the ligand binding molecule suppresses the biological activity of the ligand when bound with the ligand, and is cleaved specifically in a target tissue, the ligand does not exert biological activity during transport and exerts biological activity only when the ligand binding molecule is cleaved in the target tissue. As a result, the disease can be treated with systemic adverse reactions reduced.

In some embodiments of the present invention, a composition containing the ligand binding molecule and a composition containing the ligand can be administered separately or concurrently to an individual. Alternatively, a composition containing both the ligand binding molecule and the ligand may be administered to an individual. In the case of administering a composition containing both the ligand binding molecule and the ligand to an individual, the ligand binding molecule and the ligand in the composition may form a complex. In the case of administering both the ligand binding molecule and the ligand to an individual, the ligand binding molecule binds to the ligand administered to the individual, and the ligand binding molecule in this state bound with the ligand is transported in vivo. The ligand binding molecule transported to a target tissue can be cleaved in the target tissue so that its binding to the ligand is attenuated to release the bound ligand in the target tissue. The released ligand can exert biological activity in the target tissue and treat a disease caused by the target tissue. In the embodiments in which the ligand binding molecule suppresses the biological activity of the ligand when bound with the ligand, and is cleaved specifically in a target tissue, the ligand does not exert biological activity during transport and exerts biological activity only when the ligand binding molecule is cleaved in the target tissue. As a result, the disease can be treated with systemic adverse reactions reduced. The ligand binding molecule administered to the individual is also capable of binding to a ligand originally present in the individual, in addition to the ligand administered to the individual. The ligand binding molecule in a state bound with the ligand originally present in the individual or the ligand administered to the individual can be transported in vivo.

In some embodiments of the present invention, the fusion protein of the ligand binding molecule fused with a ligand can be administered to an individual. In these some embodiments, the ligand binding molecule and the ligand in the fusion protein are fused via or without a linker. The noncovalent bond still exists between the ligand binding molecule moiety and the ligand moiety. In the case of administering the fusion protein of the ligand binding molecule fused with a ligand to an individual, the fusion protein is transported in vivo. The ligand binding molecule moiety in the fusion protein is cleaved in a target tissue so that the noncovalent bond of the ligand binding molecule moiety to the ligand is attenuated to release the ligand and a portion of the ligand binding molecule from the fusion protein. The released ligand and the released portion of the ligand binding molecule can exert the biological activity of the ligand in the target tissue and treat a disease caused by the target tissue. In the embodiments in which the ligand binding molecule suppresses the biological activity of the ligand when bound with the ligand, and is cleaved specifically in a target tissue, the ligand in the fusion protein does not exert biological activity during transport and exerts biological activity only when the fusion protein is cleaved in the target tissue. As a result, the disease can be treated with systemic adverse reactions reduced.

The pharmaceutical composition of the present invention can be formulated by use of a method known to those skilled in the art. For example, the pharmaceutical composition can be parenterally used in an injection form of a sterile solution or suspension with water or any of other pharmaceutically acceptable liquids. The pharmaceutical composition can be formulated, for example, by appropriately combining the polypeptide with a pharmacologically acceptable carrier or medium, specifically, sterile water or physiological saline, a plant oil, an emulsifier, a suspending agent, a surfactant, a stabilizer, a flavoring agent, an excipient, a vehicle, an antiseptic, a binder, etc. and mixing them into a unit dosage form required for generally accepted pharmaceutical practice. The amount of the active ingredient in these formulations is set so as to give an appropriate volume in a prescribed range.

A sterile composition for injection can be formulated according to usual pharmaceutical practice using a vehicle such as injectable distilled water. Examples of the injectable aqueous solution include isotonic solutions containing physiological saline, glucose, or other adjuvants (e.g., D-sorbitol, D-mannose, D-mannitol, and sodium chloride). The aqueous solution can be used in combination with an appropriate solubilizer, for example, an alcohol (ethanol, etc.), a polyalcohol (propylene glycol, polyethylene glycol, etc.), or a nonionic surfactant (Polysorbate 80™, HCO-50, etc.).

Examples of the oil solution include sesame oil and soybean oil. The oil solution can also be used in combination with benzyl benzoate and/or benzyl alcohol as a solubilizer. The oil solution can be supplemented with a buffer (e.g., a phosphate buffer solution and a sodium acetate buffer solution), a soothing agent (e.g., procaine hydrochloride), a stabilizer (e.g., benzyl alcohol and phenol), and an antioxidant. The prepared injection solution is usually filled into an appropriate ampule.

The pharmaceutical composition of the present invention is preferably administered through a parenteral route. For example, a composition having an injection, transnasal, transpulmonary, or percutaneous dosage form is administered. The pharmaceutical composition can be administered systemically or locally by, for example, intravenous injection, intramuscular injection, intraperitoneal injection, or subcutaneous injection.

The administration method can be appropriately selected according to the age and symptoms of a patient. The dose of the pharmaceutical composition containing the ligand binding molecule can be set to the range of, for example, 0.0001 mg to 1000 mg per kg body weight per dose. Alternatively, the dose of the pharmaceutical composition containing the polypeptide can be set to a dose of, for example, 0.001 to 100000 mg per patient. However, the present invention is not necessarily limited by these numerical values. Although the dose and the administration method vary depending on the body weight, age, symptoms, etc. of a patient, those skilled in the art can set an appropriate dose and administration method in consideration of these conditions.

The present invention also relates to a method for producing a ligand binding molecule whose ligand binding is attenuated by cleavage, or a fusion protein of the ligand binding molecule fused with a ligand. In one embodiment, the present invention provides a method for producing the ligand binding molecule or the fusion protein, comprising introducing a protease cleavage sequence into a molecule capable of binding to a ligand.

Examples of the method for introducing a protease cleavage sequence into a molecule capable of binding to a ligand include a method of inserting the protease cleavage sequence into the amino acid sequence of a polypeptide capable of binding to the ligand, and a method of replacing a portion of the amino acid sequence of a polypeptide capable of binding to the ligand with the protease cleavage sequence.

Examples of the method for obtaining the molecule capable of binding to a ligand include a method of obtaining a ligand binding region having the ability to bind to the ligand. The ligand binding region is obtained by a method using, for example, an antibody preparation method known in the art.

The antibody obtained by the preparation method may be used directly in the ligand binding region, or only a Fv region in the obtained antibody may be used. When the Fv region in a single-chain (also referred to as "sc") form is capable of recognizing the antigen, only the single chain may be used. Alternatively, a Fab region containing the Fv region may be used.

The specific antibody preparation method is well known to those skilled in the art. For example, monoclonal antibodies may be produced by a hybridoma method (Kohler and Milstein, Nature 256: 495 (1975)) or a recombination method (U.S. Pat. No. 4,816,567). Alternatively, the monoclonal antibodies may be isolated from phage-displayed antibody libraries (Clackson et al., Nature 352: 624-628 (1991); and Marks et al., J. Mol. Biol. 222: 581-597 (1991)). Also, the monoclonal antibodies may be isolated from single B cell clones (N. Biotechnol. 28 (5): 253-457 (2011)).

Humanized antibodies are also called reshaped human antibodies. Specifically, for example, a humanized antibody consisting of a non-human animal (e.g., mouse) antibody CDR-grafted human antibody is known in the art. General gene recombination approaches are also known for obtaining the humanized antibodies. Specifically, for example, overlap extension PCR is known in the art as a method for grafting mouse antibody CDRs to human FRs.

DNA encoding an antibody variable region containing three CDRs and four FRs linked and DNA encoding a human antibody constant region can be inserted into an expression vector such that these DNAs are fused in frame to prepare a vector for humanized antibody expression. The vector having the inserts is transfected into hosts to establish recombinant cells. Then, the recombinant cells are cultured for the expression of DNA encoding the humanized antibody to produce the humanized antibody into the cultures of the cultured cells (see European Patent Publication No. 239400 and International Publication No. WO1996/002576).

If necessary, FR amino acid residues may be substituted such that the CDRs of the reshaped human antibody form an appropriate antigen binding site. For example, a mutation can be introduced to the amino acid sequence of FR by the application of the PCR method used in the mouse CDR grafting to the human FRs.

The desired human antibody can be obtained by DNA immunization using transgenic animals having all repertoires of human antibody genes (see International Publication Nos. WO1993/012227, WO1992/003918, WO1994/002602, WO1994/025585, WO1996/034096, and WO1996/033735) as animals to be immunized.

In addition, a technique of obtaining human antibodies by panning using a human antibody library is also known. For example, a human antibody Fv region is expressed as a single-chain antibody (also referred to as "scFv") on the surface of phages by a phage display method. A phage expressing antigen binding scFv can be selected. The gene of the selected phage can be analyzed to determine a DNA sequence encoding the Fv region of the antigen binding human antibody. After the determination of the DNA sequence of the antigen binding scFv, the Fv region sequence can be fused in frame with the sequence of the desired human antibody C region and then inserted into an appropriate expression vector to prepare an expression vector. The expression vector is transfected into the preferred expression cells listed above for the expression of the gene encoding the human antibody to obtain the human antibody. These methods are already known in the art (see International Publication Nos. WO1992/001047, WO1992/020791, WO1993/006213, WO1993/011236, WO1993/019172, WO1995/001438, and WO1995/015388).

The molecule harboring the protease cleavage sequence in the molecule capable of binding to a ligand serves as the ligand binding molecule of the present invention. Whether the ligand binding molecule is cleaved by treatment with protease appropriate for the protease cleavage sequence can be optionally confirmed. The presence or absence of the cleavage of the protease cleavage sequence can be confirmed, for example, by contacting the protease with the molecule harboring the protease cleavage sequence in the molecule capable of binding to a ligand, and confirming the molecular weight of the protease treatment product by an electrophoresis method such as SDS-PAGE.

The present invention also relates to a polynucleotide encoding a ligand binding molecule whose ligand binding is attenuated by cleavage, or a polynucleotide encoding a fusion protein of the ligand binding molecule fused with a ligand.

The polynucleotide according to the present invention is usually carried by (or inserted in) an appropriate vector and transfected into host cells. The vector is not particularly limited as long as the vector can stably retain an inserted nucleic acid. For example, when E. coli is used as the host, a pBluescript vector (manufactured by Stratagene Corp.) or the like is preferred as a vector for cloning. Various commercially available vectors can be used. In the case of using the vector for the purpose of producing the ligand binding molecule or the fusion protein of the present invention, an expression vector is particularly useful. The expression vector is not particularly limited as long as the vector permits expression of the ligand binding molecule in vitro, in E. coli, in cultured cells, or in organism individuals. The expression vector is preferably, for example, a pBEST vector (manufactured by Promega Corp.) for in vitro expression, a pET vector (manufactured by Invitrogen Corp.) for E. coli, a pME18S-FL3 vector (GenBank Accession No. AB009864) for cultured cells, and a pME18S vector (Mol Cell Biol. 8: 466-472 (1988)) for organism individuals. The insertion of the DNA of the present invention into the vector can be performed by a routine method, for example, ligase reaction using restriction sites (Current protocols in Molecular Biology edit. Ausubel et al. (1987) Publish. John Wiley & Sons. Section 11.4-11.11).

The host cells are not particularly limited, and various host cells are used according to the purpose. Examples of the cells for expressing the ligand binding molecule or the fusion protein can include bacterial cells (e.g., *Streptococcus, Staphylococcus, E. coli, Streptomyces*, and *Bacillus subtilis*), fungal cells (e.g., yeasts and *Aspergillus*), insect cells (e.g., *Drosophila* S2 and *Spodoptera* SF9), animal cells (e.g., CHO, COS, HeLa, C127, 3T3, BHK, HEK293, and Bowes melanoma cells) and plant cells. The transfection of the vector to the host cells may be performed by a method known in the art, for example, a calcium phosphate precipitation method, an electroporation method (Current protocols in Molecular Biology edit. Ausubel et al., (1987) Publish. John Wiley & Sons. Section 9.1-9.9), a Lipofectamine method (manufactured by GIBCO-BRL/Thermo Fisher Scientific Inc.), or a microinjection method.

An appropriate secretory signal can be incorporated into the ligand binding molecule or the fusion protein of interest in order to secrete the ligand binding molecule or the fusion protein expressed in the host cells to the lumen of the endoplasmic reticulum, periplasmic space, or an extracellular environment. The signal may be endogenous to the ligand binding molecule or the fusion protein of interest or may be a foreign signal.

When the ligand binding molecule or the fusion protein of the present invention is secreted into a medium, the recovery of the ligand binding molecule or the fusion protein in the production method is performed by the recovery of the medium. When the ligand binding molecule or the fusion protein of the present invention is produced into cells, the cells are first lysed, followed by the recovery of the ligand binding molecule or the fusion protein.

A method known in the art including ammonium sulfate or ethanol precipitation, acid extraction, anion- or cation-exchange chromatography, phosphocellulose chromatography, hydrophobic interaction chromatography, affinity chromatography, hydroxyapatite chromatography, and lectin chromatography can be used for recovering and purifying the ligand binding molecule or the fusion protein of the present invention from the recombinant cell cultures.

It should be understood by those skilled in the art that arbitrary combinations of one or more embodiments described in the present specification are also included in the present invention unless there is technical contradiction on the basis of the technical common sense of those skilled in the art. Also, the present invention excluding arbitrary combinations of one or more embodiments described in the present specification is intended in the present specification and should be interpreted as the described invention, unless there is technical contradiction on the basis of the technical common sense of those skilled in the art.

EXAMPLES

Hereinafter, Examples of the method and the composition of the present invention will be described. It shall be understood that various other embodiments can be carried out in light of the general description mentioned above.

Example 1 Problem of Previously Reported Immunocytokine and Protease-Activated Cytokine Immunocytokines targeting antigens expressed in cancer tissues have generally been prepared by fusing the cytokine of interest to the end of targeting IgG or scFv (Expert Opin Investig Drugs. 2009 July; 18 (7): 991-1000; and Curr Opin Immunol. 2016 June; 40: 96-102). Since cytokines including IL2, IL12, and TNF have strong toxicity, it is expected for the local action of these cytokines on cancer that the local delivery to the cancer by an antibody strengthens their effects while alleviating adverse reactions (Non Patent Literatures 4, 5, and 6). However, all of these cytokines present problems that, for example: they do not clinically exhibit a sufficient effect by systemic administration; their therapeutic windows are narrow; and they cannot be systemically administered due to strong toxicity. This is largely because cytokines including immunocytokines, when systemically administered, are exposed to the whole bodies and are therefore capable of exhibiting toxicity by systemic action, or the cytokines can be administered only at very low doses in order to circumvent the toxicity. Moreover, immunocytokines binding to cancer antigens disappear through internalization by cancer cells in tumors and therefore have the difficulty in locally exposing cytokines to cancer in some cases. It has also been reported that an immunocytokine containing IL2 fused with an antibody binding to a cancer antigen and an immunocytokine containing IL2 fused with an antibody that does not bind to the cancer antigen did not vary in an antitumor effect (Non Patent Literature 7).

A molecule containing a cytokine and a cytokine receptor connected via a linker that is cleaved by protease highly expressed in cancer has been reported as a method for reducing the systemic action, which is a major problem of the immunocytokines. The cytokine is inhibited by the cytokine receptor connected therewith via the linker, while the cytokine is released from the cytokine receptor by the protease cleavage of the linker and thereby becomes an active form. As an example, a molecule containing TNF-alpha and TNFR connected via a linker that is cleaved by uPA (Non Patent Literature 8), and a molecule containing IL2 and IL2R connected via a linker that is cleaved by MMP2 (Non Patent Literature 9) have been reported. However, the cytokines in these molecules have biological activity even before cleavage of the linker, and the cleavage of the linker improves the activity by only approximately 10 times.

This is because: the cytokines do not have strong affinity for their receptors and therefore are active to some extent even before protease cleavage; and the cytokine receptors can bind to the cytokines even after protease cleavage of the linker and therefore inhibit the biological activity of the cytokines.

A molecule containing IL2 connected with anti-IL2 scFv instead of IL2R via a linker that is cleaved by MMP-2 (Non Patent Literature 9) has been reported. The anti-IL2 scFv used in this molecule containing IL2 connected with the anti-IL2 scFv via a protease-cleavable linker does not have strong IL2 affinity, as a matter of course, considering that IL2 is released by the cleavage of the linker, as in the molecule containing a cytokine connected with a cytokine receptor.

Unlike the IgG-IL2 fusion mentioned above, these reported protease-activated cytokines have no Fc region and therefore presumably have a short half-life. Thus, it is difficult to maintain high exposure. The cytokines do not largely differ in pharmacokinetics between before and after activation by protease cleavage (have a short half-life both before and after the activation). Thus, it is difficult to expand their therapeutic windows.

Example 2 Problem Associated with Application of Chemokine to Cancer Immunotherapy Chemokines (Nature Immunology 9, 949-952 (2008)) are basic proteins that exert their effects via G protein-coupled receptors and are a group of cytokines. The chemokines act on receptor-expressing particular leukocytes and have the activity of causing migration (chemotaxis) of the leukocytes along with the concentration gradients of the agents (Nat Cell Biol. 2016 January; 18 (1): 43-53). The chemokines are produced in large amounts at inflammatory areas and are known to bring about leukocyte migration from vascular vessels into inflammatory tissues.

The chemokines might be exploited in cancer immunotherapy because leukocyte migration can be controlled by controlling the chemokines. If the local migration of T cells, antigen-presenting cells, M1 macrophages, etc. to solid cancer is attained, it may be possible to elicit an antitumor effect. Cytokines can function even by systemic administration, whereas the chemokines guide the cells towards tissues of increasing concentration through their concentration gradients and therefore cannot achieve an expected effect by systemic administration. Hence, cancer immunotherapy with the chemokines by systemic administration (chemokine therapy) is considered unpractical.

Example 3 Concept of Ligand Binding Molecule Harboring Protease Cleavage Sequence and Capable of Releasing Ligand Specific for Target Tissue As shown in Examples 1 and 2, the previously reported cytokine or chemokine therapy present the following problems:

1. Immunocytokines, even if performing cytokine targeting in solid cancer by an antibody, cause adverse reactions because cytokines act systemically, or are administered only at low doses in order to circumvent such adverse reactions and therefore, cannot be highly exposed into tumor.
2. In protease-activated cytokines containing a cytokine receptor (or an antibody) and a cytokine connected via a protease-cleavable linker, the cytokine is active to some extent even before protease cleavage due to the insufficient neutralization of the cytokine activity.
3. In the protease-activated cytokines, the cytokine receptor (or the antibody) can bind to the cytokine even after protease cleavage of the linker and therefore inhibits the biological activity of the cytokine.
4. In the protease-activated cytokines, a necessary dose is large because an inactive cytokine has a short half-life and has a short circulation time in blood.

The present inventors thought that it is important for solving these problems to satisfy the following conditions:
1. A ligand such as a cytokine or a chemokine is sufficiently inhibited (its biological activity is minimized) by a ligand binding molecule in the whole body.
2. The ligand restores its biological activity (becomes an active ligand) by protease cleavage.
3. The ligand binding molecule loses its ligand binding activity by protease cleavage.
4. The ligand activated by protease cleavage has a shorter half-life than that of the ligand bound with the ligand binding molecule before the protease cleavage.

The present inventors devised a molecule whose ligand binding is attenuated by the cleavage of a cleavage site, as a pharmaceutical composition that satisfied the conditions described above. Such a ligand binding molecule can be prepared by first obtaining a binding molecule against the ligand and subsequently inserting a cleavage site into the binding molecule.

Example 4 Example of Anti-Ligand Antibody Harboring Protease Cleavage Sequence

Figure 1:
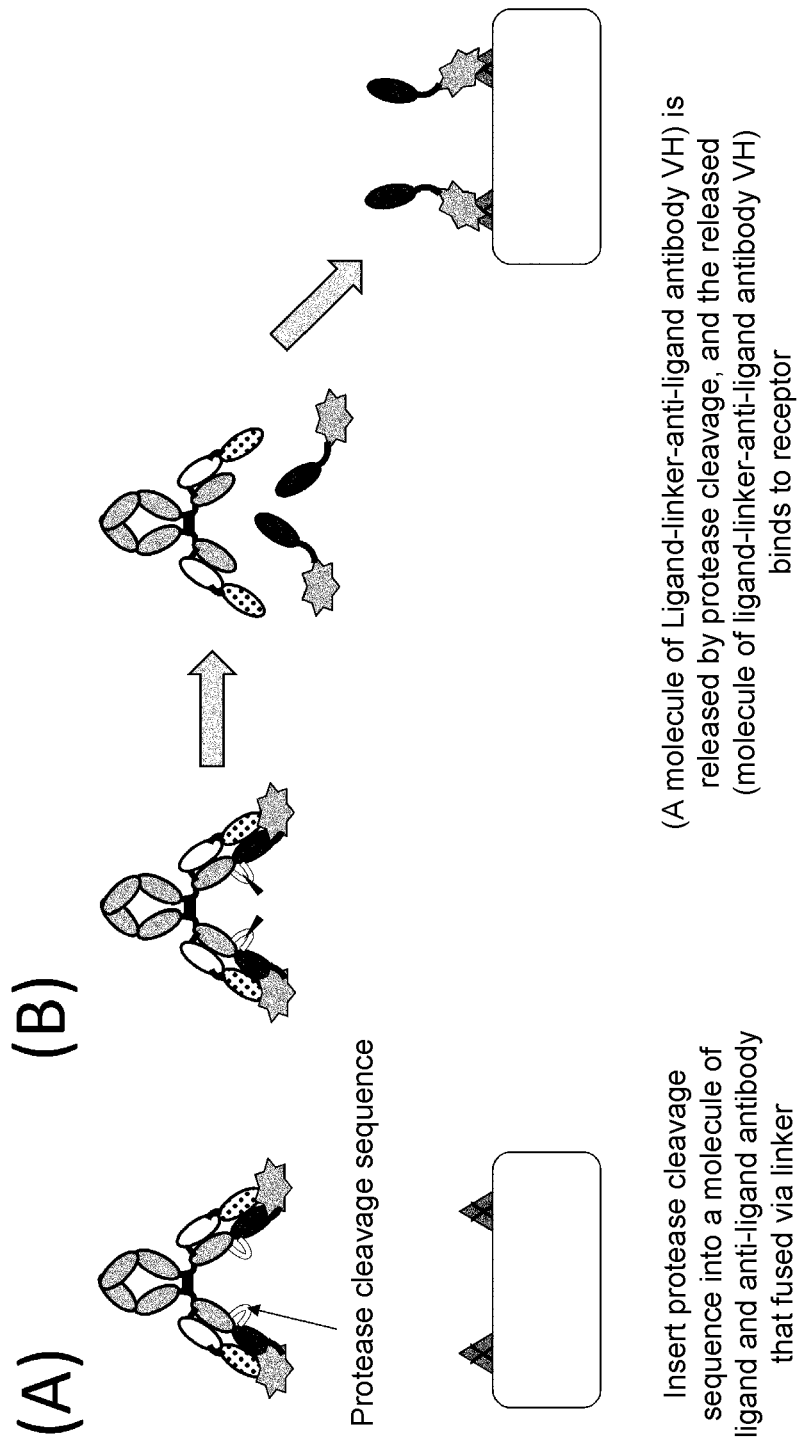
FIG. 1 is a diagram showing a fusion protein of an IgG antibody and a ligand containing a ligand-linker-anti-ligand antibody VH molecule specifically released in a target tissue, and one mode of activation thereof. The ligand and the anti-ligand antibody are fused via the linker.
Figure 2:
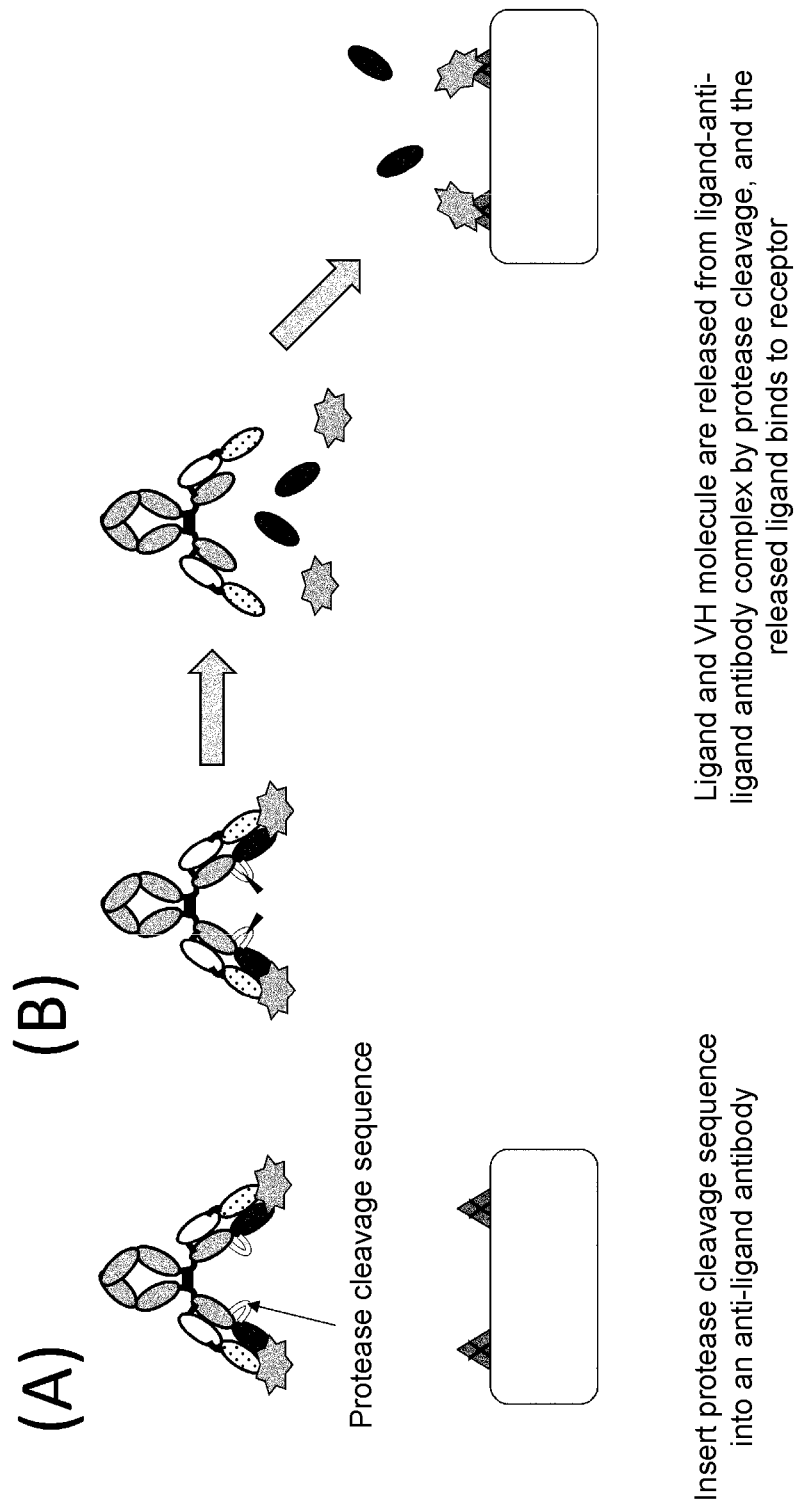
FIG. 2 is a diagram showing an IgG antibody that releases a ligand specifically in a target tissue, and one mode of activation thereof. An anti-ligand antibody harboring a protease cleavage sequence near the boundary between VH and CH1 is mixed with the ligand and administered to an individual.
Figure 3:
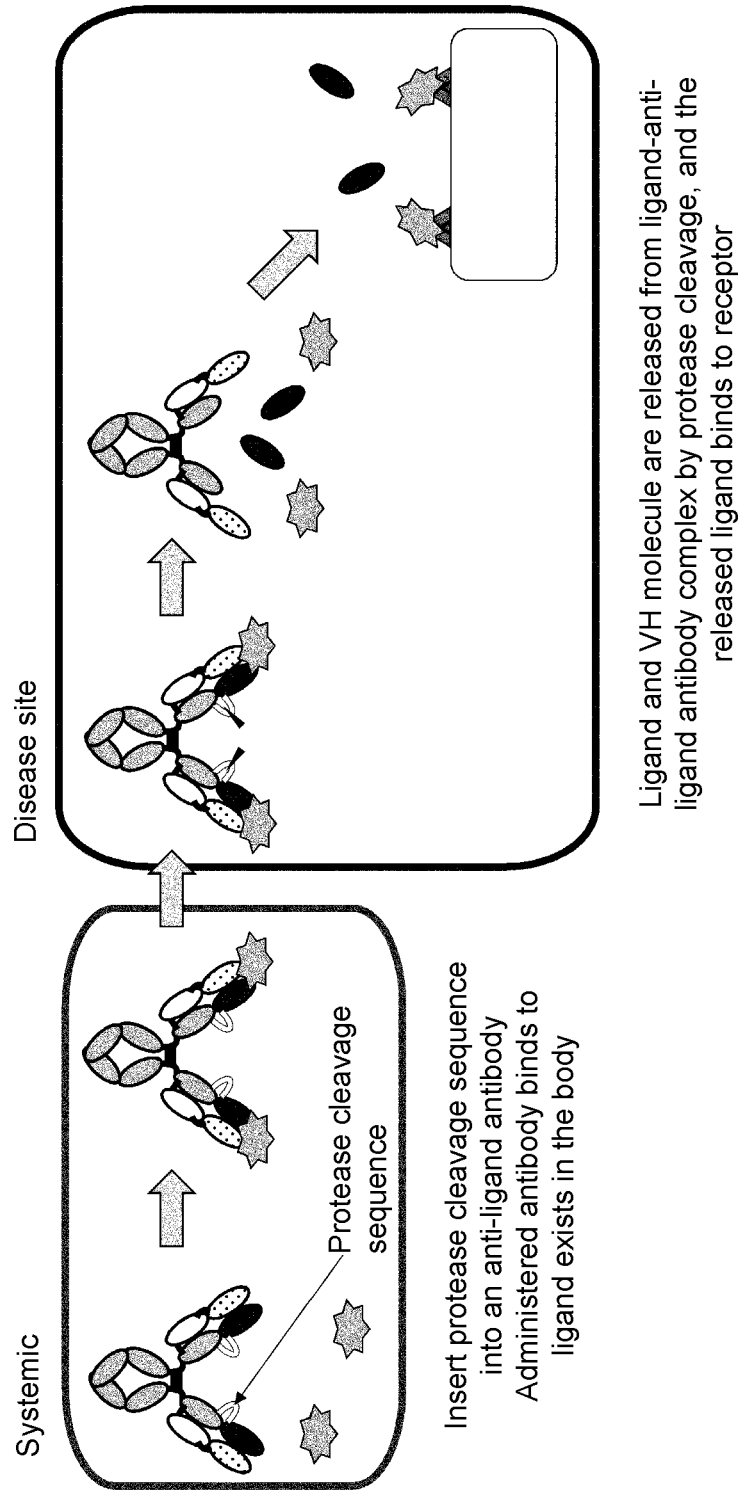
FIG. 3 is a diagram showing an IgG antibody that releases a ligand specifically in a target tissue, and one mode of activation thereof Δn anti-ligand antibody harboring a protease cleavage sequence near the boundary between VH and CH1 is administered to an individual. The administered antibody binds to a ligand originally present in the body. The subsequent course is the same as in the activation mode of FIG. 2.

FIGS. 1, 2, and 3 show examples of molecules using an antibody as the ligand binding molecule. In these examples, a neutralizing antibody against the ligand is first obtained. Subsequently, a protease cleavage sequence is inserted near the boundary between the variable region (VH or VL) and the constant region (CH1 or CL) of the anti-ligand neutralizing antibody. It is confirmed that the anti-ligand antibody maintains its ligand binding activity after the protease cleavage sequence insertion. It is confirmed that the ligand is dissociated from the anti-ligand neutralizing antibody by the protease cleavage of the anti-ligand neutralizing antibody fused or bound with the ligand. It is confirmed that the ligand thus dissociated exerts biological activity.

In FIG. 1, the C terminus of the ligand and the N terminus of VH of the anti-ligand antibody are connected via a linker, and a protease cleavage sequence is inserted near the boundary between the VH and CH1. Provided that the anti-ligand antibody has sufficiently strong affinity for the ligand, the biological activity of the ligand is sufficiently inhibited. This ligand-anti-ligand antibody fusion does not exert the biological activity even by systemic administration because the ligand is neutralized. Furthermore, the ligand-anti-ligand antibody fusion has a Fc region and therefore has a long half-life. From the systemically administered ligand-anti-ligand antibody fusion, a ligand-linker-anti-ligand antibody VH molecule is released when the protease cleavage sequence near the boundary between VH and CH1 is cleaved by protease highly expressed in a tumor tissue. Since VH or VL alone cannot bind to the ligand (both VH and VL are necessary for binding to the ligand), the neutralization of the ligand is canceled so that the ligand is capable of exerting its biological effect in the tumor tissue. Also, this released molecule of ligand-linker-anti-ligand antibody VH has a small molecular weight without retaining a Fc region and therefore has a very short half-life and disappears rapidly from the whole body. Hence, the systemic adverse reactions caused by the ligand can be minimized.

In FIG. 2, the ligand and the anti-ligand antibody are not connected via a linker, unlike FIG. 1, and an anti-ligand antibody harboring a protease cleavage sequence near the boundary between VH and CH1 is mixed with the ligand and administered. Provided that the anti-ligand antibody has sufficiently strong affinity for the ligand and is at an adequate level for the ligand concentration, the biological activity of the ligand is sufficiently inhibited. This ligand-anti-ligand antibody complex does not exert the biological activity even by systemic administration because the ligand is neutralized. Furthermore, the ligand-anti-ligand antibody complex has a Fc region and therefore has a long half-life. From the systemically administered ligand-anti-ligand antibody complex, an anti-ligand antibody VH molecule is released when the protease cleavage sequence near the boundary between VH and CH1 is cleaved by protease highly expressed in a tumor tissue. Since VH or VL alone cannot bind to the ligand (both VH and VL are necessary for binding to the ligand), the neutralization of the ligand is canceled so that the ligand is capable of exerting its biological effect in the tumor tissue. Also, this released ligand molecule has a small molecular weight without retaining a Fc region and therefore has a very short half-life and disappears rapidly from the whole body. Hence, the systemic adverse reactions caused by the ligand can be minimized.

In FIG. 3, an anti-ligand antibody harboring a protease cleavage sequence near the boundary between VH and CH1 is systemically administered. The administered antibody binds to a ligand originally present in the body. The subsequent course is the same as in the above description about FIG. 2.

Thus, use of the anti-ligand antibody harboring a protease cleavage sequence near the boundary between VH and CH1 can release the ligand selectively in a protease-expressing tissue and allow the ligand to exert its biological effect. When the ligand is a cytokine, the cytokine can be allowed to act selectively in a protease-expressing tissue. When the ligand is a chemokine, the chemokine can guide chemokine receptor-expressing cells to a protease-expressing tissue because the chemokine is present at a high concentration in the protease-expressing tissue and has a low concentration in peripheral blood.

Example 5 Preparation and Evaluation of CXCL10 Releasing Antibody 5-1. Introduction of Protease Cleavage Sequence to Anti-CXCL10 Neutralizing Antibody CXCL10 is a chemokine having a chemotactic effect on effector T cells. An expression vector of MabCXCL10 (heavy chain: EEIVH (SEQ ID NO: 1), light chain: EEIVL (SEQ ID NO: 2)), a neutralizing antibody against human CXCL10, was prepared by a method known to those skilled in the art, and expressed using FreeStyle 293 (Life Technologies Corp.) and purified by methods known to those skilled in the art. MabCXCL10 contained the following CDR sequences: H-CDR1 (NNGMH; SEQ ID NO: 380), H-CDR2 (VIWFDGMNKFYVDSVKG; SEQ ID NO: 381), H-CDR3 (EGDGSGIYYYYGMDV; SEQ ID NO: 382), L-CDR1 (RASQSVSSSYLA; SEQ ID NO: 383), L-CDR2 (GASSRAT; SEQ ID NO: 384), and L-CDR3 (QQYGSSPIFT; SEQ ID NO: 385).

Figure 4:
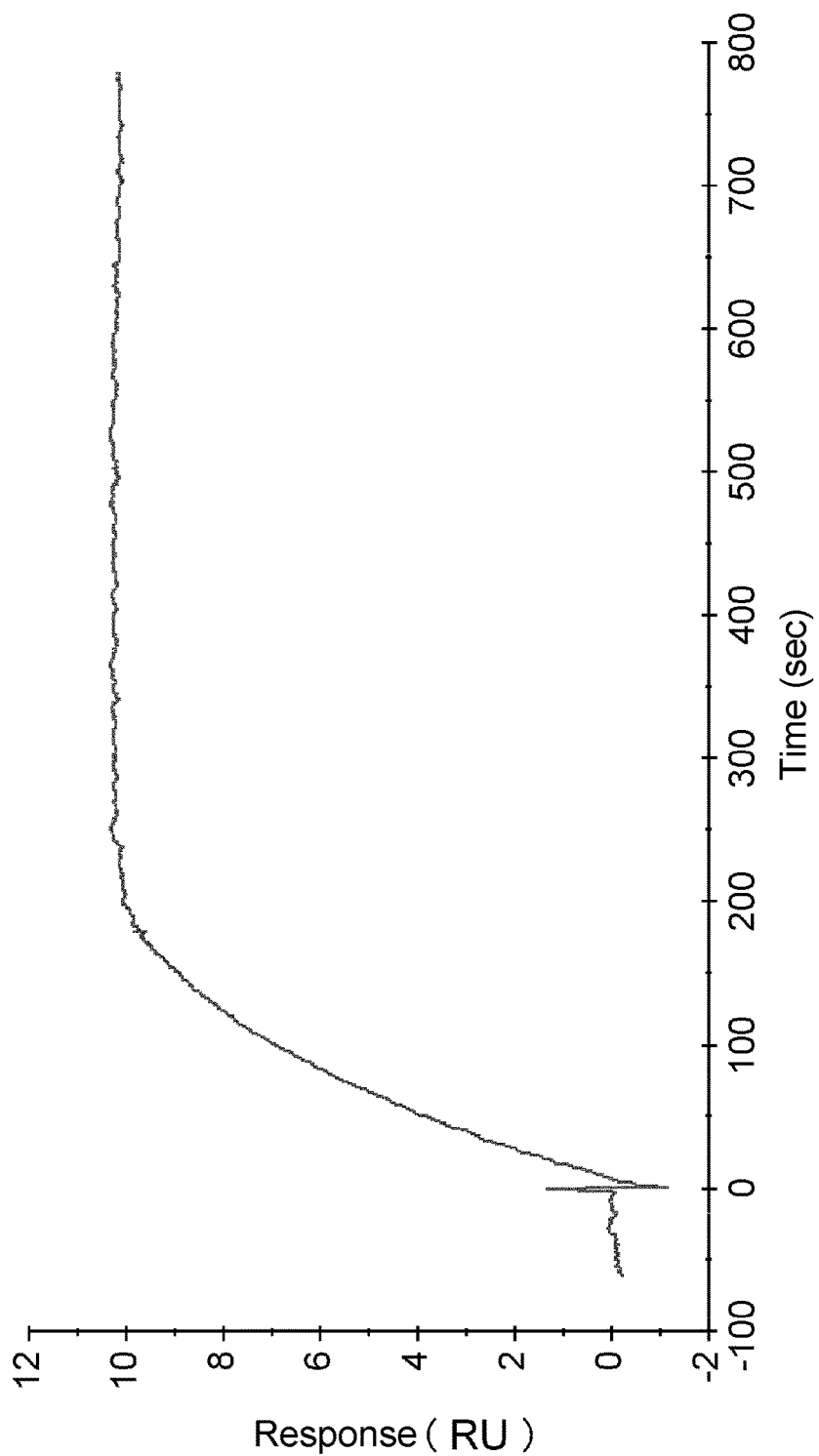
FIG. 4 is a diagram showing results of evaluating the interaction between MabCXCL10 and human CXCL10 using Biacore.

The interaction between MabCXCL10 and human CXCL10 (266-IP-010/CF, R&D Systems, Inc.) was evaluated using Biacore. Specifically, R PROTEIN A (SURE) (28-4018-60, GE Healthcare Japan Corp.) was immobilized onto CM3 sensor chip (BR100536, GE Healthcare Japan Corp.) by the amine coupling method using NHS.EDC. The running buffer used was 20 mM ACES, 0.05% Tween 20, and 200 mM NaCl (pH 7.4). 1.563 nM human CXCL10 was injected thereto as an analyte with the antibody captured, and the binding of the antibody to the antigen was evaluated at 37° C. A sensorgram showing profiles of SPR response plotted against time after blank subtraction using an analyte consisting only of the running buffer is shown in FIG. 4. The start time of analyte injection was plotted as a starting point on the abscissa. When the response at the start time of analyte injection was defined as 0, a response at each point in time was plotted on the ordinate. As shown in the sensorgram of FIG. 4, the binding of MabCXCL10 to the human CXCL10 was confirmed.

Figure 5A:
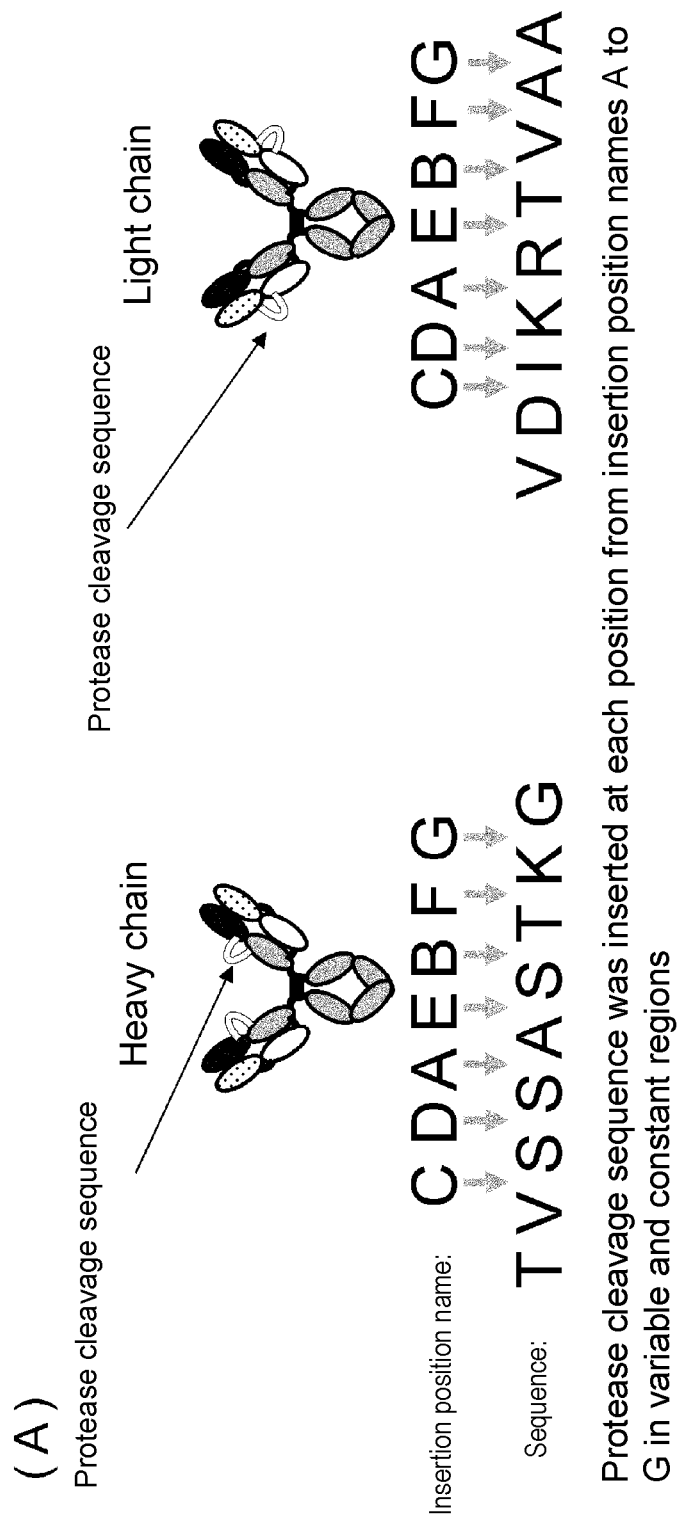
FIG. 5A is a diagram showing antibody molecule models prepared by inserting a protease cleavage sequence near the boundary between the antibody variable region and constant region of MabCXCL10.

Study was conducted to insert a protease cleavage sequence near the boundary between the heavy chain or light chain variable region and constant region of MabCXCL10. Heavy chains and light chains shown in FIG. 5 were designed such that peptide sequence A (SEQ ID NO: 3), a reported sequence cleavable by cancer-specifically expressed urokinase (uPA) and matriptase (MT-SP1), was inserted at 7 sites near the boundary between the heavy chain or light chain variable region and constant region. Variants into which cleavage sequence are inserted while glycosylation is evaded were also designed. Expression vectors encoding the heavy chain variants EEIVHA (SEQ ID NO: 4), EEIVHB (SEQ ID NO: 5), EEIVHC (SEQ ID NO: 6), EEIVHD (SEQ ID NO: 7), EEIVHE (SEQ ID NO: 8), EEIVHF (SEQ ID NO: 9), EEIVHG (SEQ ID NO: 10), EEIVHBG (SEQ ID NO: 11), EEIVHCG (SEQ ID NO: 12), EEIVHDG (SEQ ID NO: 13), and EEIVHEG (SEQ ID NO: 14), and the light chain variants EEIVLA (SEQ ID NO: 15), EEIVLB (SEQ ID NO: 16), EEIVLC (SEQ ID NO: 17), EEIVLD (SEQ ID NO: 18), EEIVLE (SEQ ID NO: 19), EEIVLF (SEQ ID NO: 20), EEIVLG (SEQ ID NO: 21), and EEIVLEG (SEQ ID NO: 22) were prepared by a method known to those skilled in the art.

IgG1 antibodies EEIVHA/EEIVL (heavy chain: SEQ ID NO: 4, light chain: SEQ ID NO: 2), EEIVHB/EEIVL (heavy chain: SEQ ID NO: 5, light chain: SEQ ID NO: 2), EEIVHC/EEIVL (heavy chain: SEQ ID NO: 6, light chain: SEQ ID NO: 2), EEIVHD/EEIVL (heavy chain: SEQ ID NO: 7, light chain: SEQ ID NO: 2), EEIVHE/EEIVL (heavy chain: SEQ ID NO: 8, light chain: SEQ ID NO: 2), EEIVHF/EEIVL (heavy chain: SEQ ID NO: 9, light chain: SEQ ID NO: 2), EEIVHG/EEIVL (heavy chain: SEQ ID NO: 10, light chain: SEQ ID NO: 2), EEIVHBG/EEIVL (heavy chain: SEQ ID NO: 11, light chain: SEQ ID NO: 2), EEIVHCG/EEIVL (heavy chain: SEQ ID NO: 12, light chain: SEQ ID NO: 2), EEIVHDG/EEIVL (heavy chain: SEQ ID NO: 13, light chain: SEQ ID NO: 2), and EEIVHEG/EEIVL (heavy chain: SEQ ID NO: 14, light chain: SEQ ID NO: 2) harboring the protease cleavage sequence near the boundary between the heavy chain variable region and constant region, and IgG1 antibodies EEIVH/EEIVLA (heavy chain: SEQ ID NO: 1, light chain: SEQ ID NO: 15), EEIVH/EEIVLB (heavy chain: SEQ ID NO: 1, light chain: SEQ ID NO: 16), EEIVH/EEIVLC (heavy chain: SEQ ID NO: 1, light chain: SEQ ID NO: 17), EEIVH/EEIVLD (heavy chain: SEQ ID NO: 1, light chain: SEQ ID NO: 18), EEIVH/EEIVLE (heavy chain: SEQ ID NO: 1, light chain: SEQ ID NO: 19), EEIVH/EEIVLF (heavy chain: SEQ ID NO: 1, light chain: SEQ ID NO: 20), EEIVH/EEIVLG (heavy chain: SEQ ID NO: 1, light chain: SEQ ID NO: 21), and EEIVH/EEIVLEG (heavy chain: SEQ ID NO: 1, light chain: SEQ ID NO: 22) harboring the protease cleavage sequence near the boundary between the light chain variable region and constant region were expressed by transient expression using these heavy chain variants in combination with a natural light chain or the light chain variants in combination with a natural heavy chain and using FreeStyle 293 (Life Technologies Corp.) by a method known to those skilled in the art, and purified by a method known to those skilled in the art using protein A.

Figure 6A:
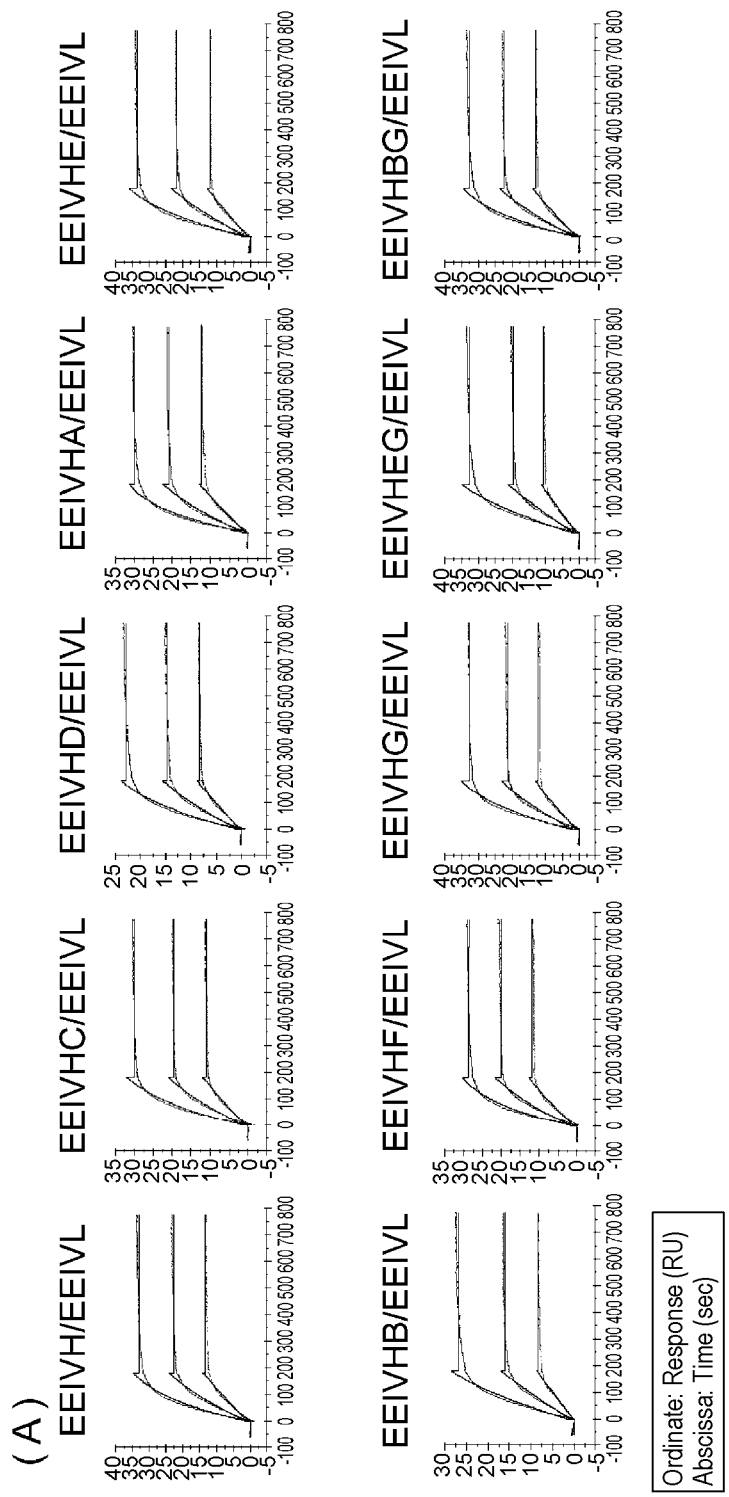
FIG. 6A is a diagram showing results of evaluating the interaction of human CXCL10 with each antibody molecule prepared by inserting a protease cleavage sequence near the boundary between the heavy chain variable region and constant region of MabCXCL10, using Biacore.
Figure 6B:
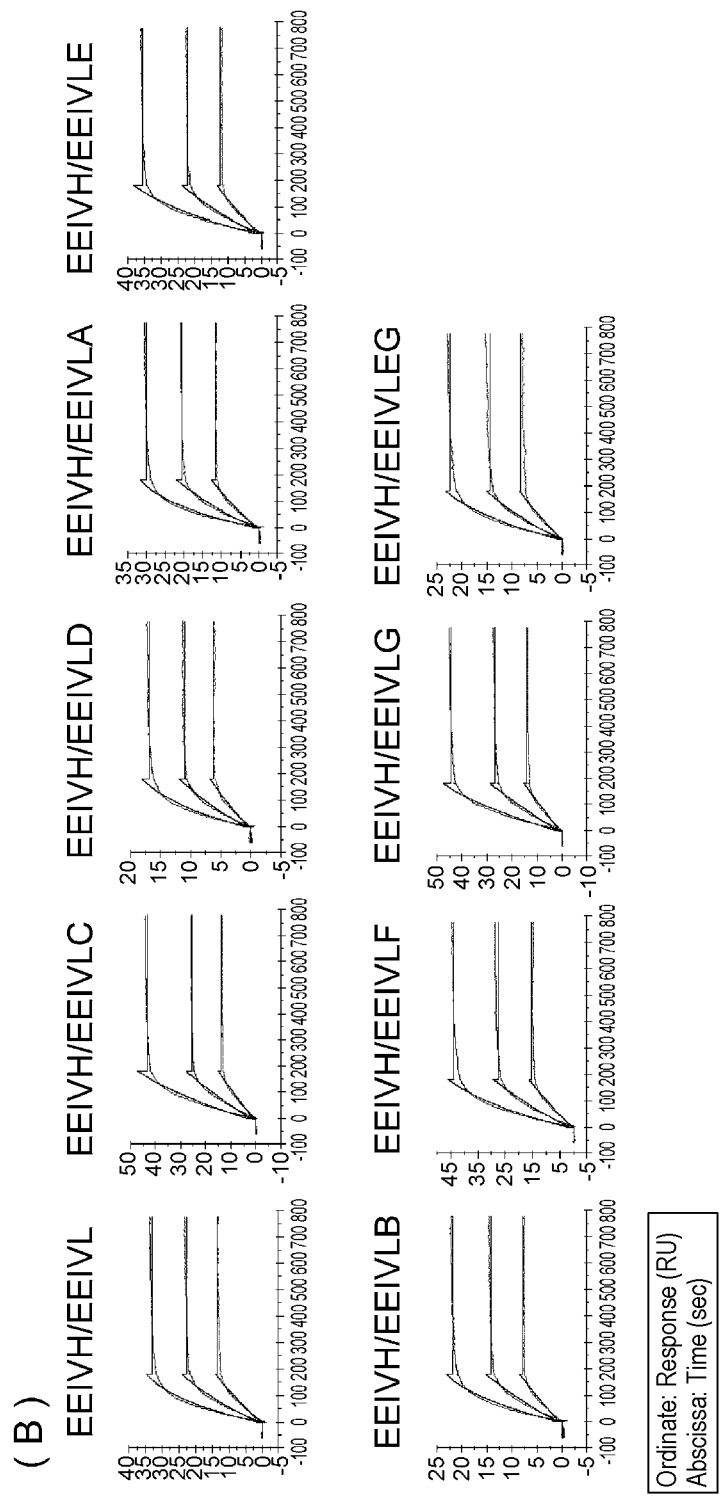
FIG. 6B is a diagram showing results of evaluating the interaction of human CXCL10 with each antibody molecule prepared by inserting a protease cleavage sequence near the boundary between the light chain variable region and constant region of MabCXCL10, using Biacore.

5-2. Binding Activity Evaluation of Anti-CXCL10 Neutralizing Antibody Harboring Protease Cleavage Sequence The antibodies prepared in Example 5-1 were evaluated for their interaction with human CXCL10 (266-IP-010/CF, R&D Systems, Inc.) using Biacore. The results are shown in FIG. 6. Specifically, R PROTEIN A (SURE) (28-4018-60, GE Healthcare Japan Corp.) was immobilized onto CM3 sensor chip (BR100536, GE Healthcare Japan Corp.) by the amine coupling method using NHS.EDC. The running buffer used was 20 mM ACES, 0.05% Tween 20, and 150 mM NaCl (pH 7.4). 3.125, 1.563, or 0.781 nM human CXCL10 was injected thereto as an analyte with each antibody captured, and the binding of the antibody to the antigen was evaluated at 25° C. Sensorgrams showing profiles of SPR response plotted against time after blank subtraction using an analyte consisting only of the running buffer are shown in FIG. 6. The start time of analyte injection was plotted as a starting point on the abscissa. When the response at the start time of analyte injection was defined as 0, a response at each point in time was plotted on the ordinate. As shown in the sensorgrams of FIG. 6, all the antibodies bound to human CXCL10. Thus, the protease cleavage sequence was able to be inserted near the boundary between the antibody variable region and constant region without losing antigen binding activity.

Figures 1, 7:
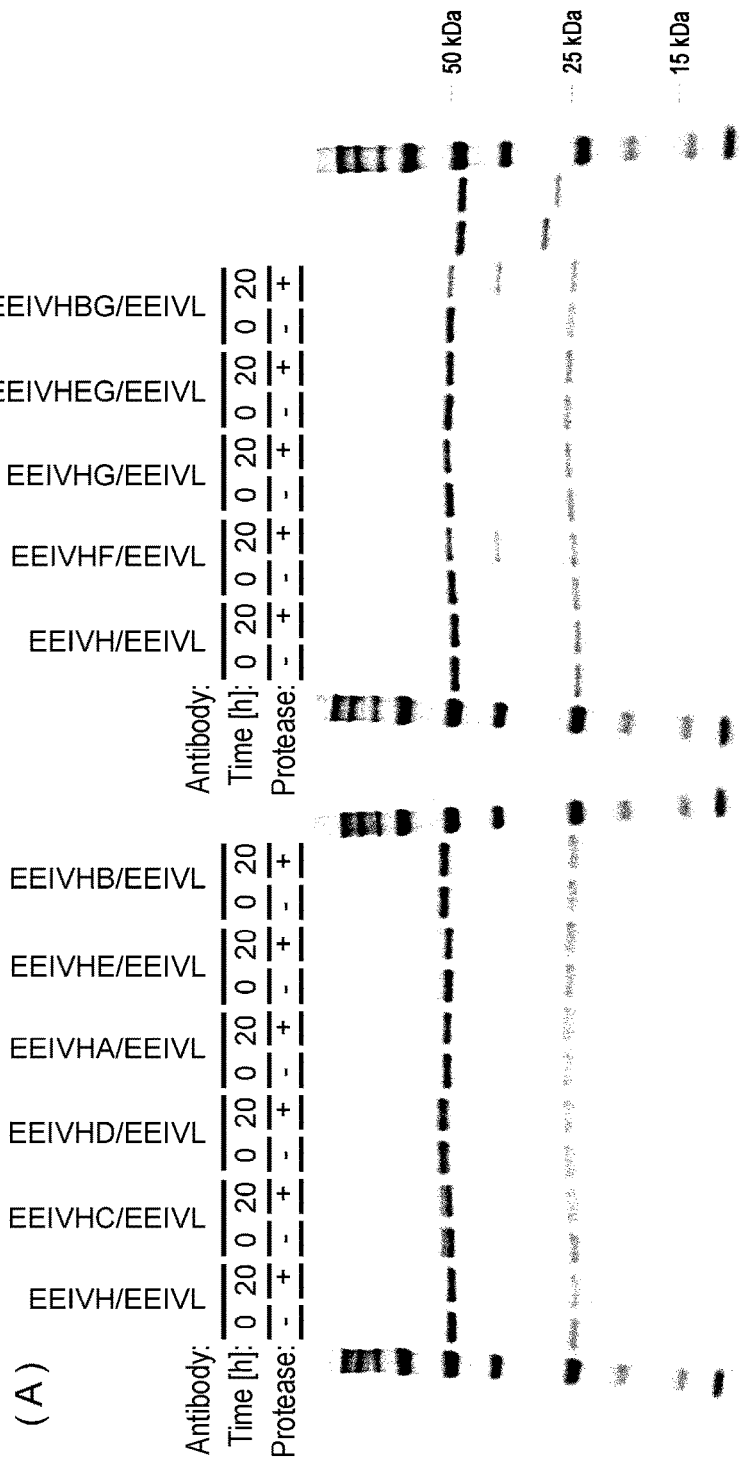
Figures 2, 7:
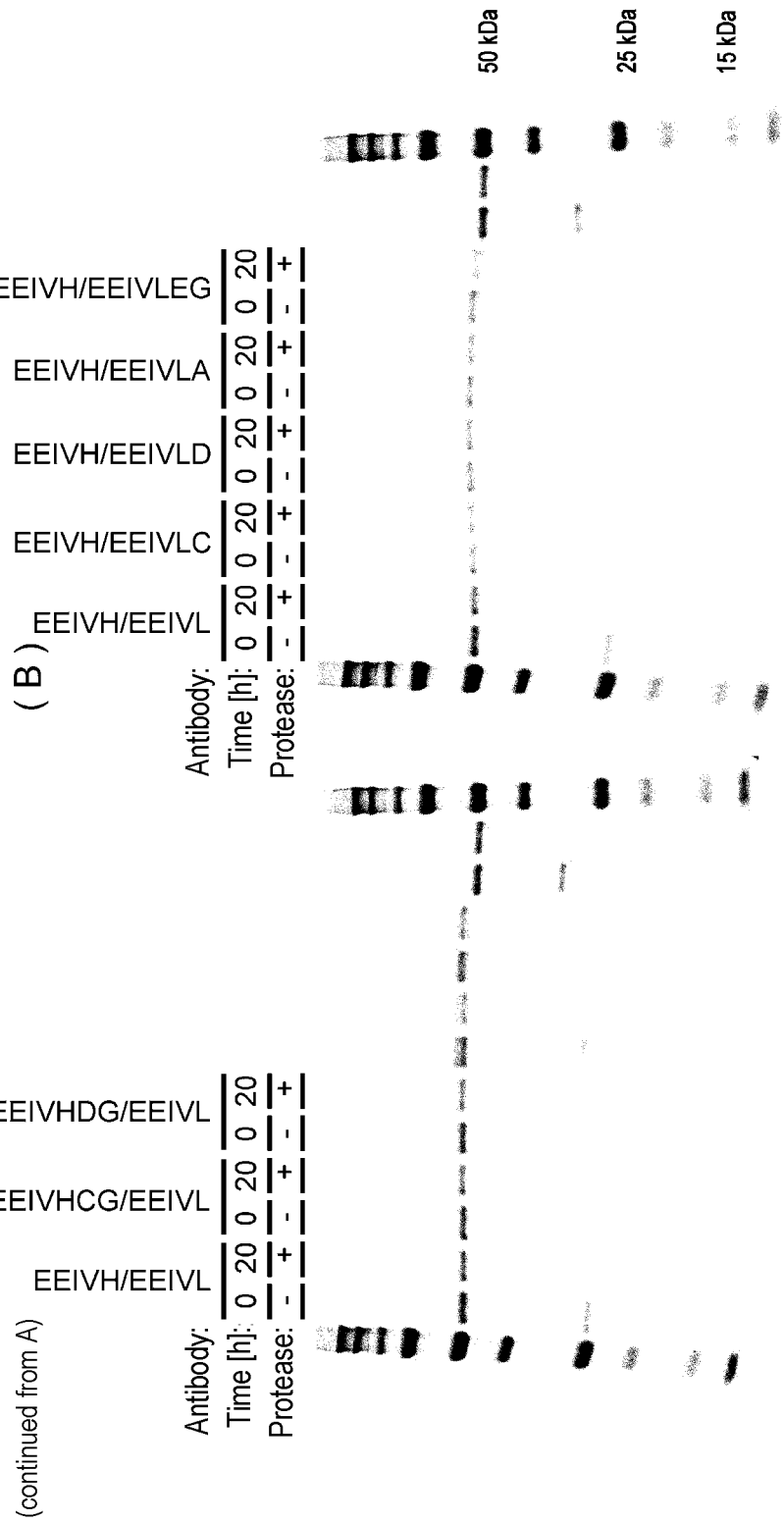
Figures 3, 7:
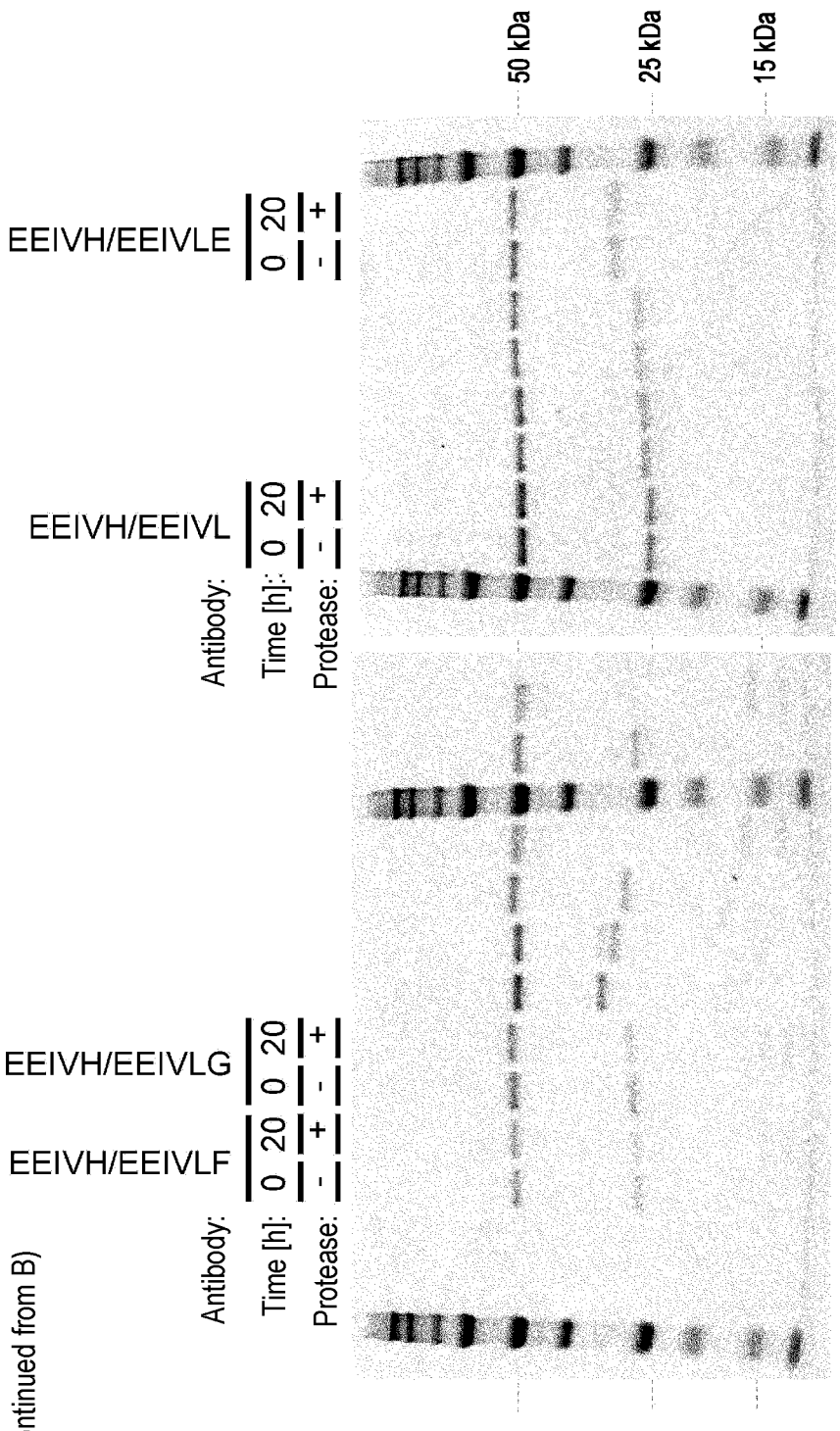

5-3. Protease Cleavage Evaluation of Anti-CXCL10 Neutralizing Antibody Harboring Protease Cleavage Sequence Whether the antibodies prepared in Example 5-1 would be cleaved by protease was verified. Recombinant Human Matriptase/ST14 Catalytic Domain (MT-SP1) (R&D Systems, Inc., 3946-SE-010) was used as the protease. 20 nM protease and 60 or 100 μg/mL of each antibody were reacted in PBS under a condition of 37° C. for 20 hours. Then, cleavage by the protease was evaluated by reducing SDS-PAGE. The results are shown in FIG. 7. As a result, the protease treatment of EEIVHA/EEIVL, EEIVHE/EEIVL, EEIVHF/EEIVL, EEIVHG/EEIVL, EEIVHEG/EEIVL, and EEIVHBG/EEIVL generated a new band between 25 kDa and 50 kDa. The protease treatment of EEIVH/EEIVLEG, EEIVH/EEIVLF, and EEIVH/EEIVLG generated a band at 25 kDa or smaller. Thus, the antibodies EEIVHA/EEIVL, EEIVHE/EEIVL, EEIVHF/EEIVL, EEIVHG/EEIVL, EEIVHEG/EEIVL, EEIVHBG/EEIVL, EEIVH/EEIVLEG, EEIVH/EEIVLF, and EEIVH/EEIVLG were confirmed to be cleaved by protease.

5-4. Introduction of Flexible Linker Sequence in Vicinity of Protease Cleavage Sequence in Anti-CXCL10 Neutralizing Antibody Harboring the Protease Cleavage Sequence Study was conducted to insert a sequence containing a linker consisting of a glycine-serine polymer in the vicinity of the protease cleavage sequence of EEIVHC/EEIVL that did not undergo the cleavage by recombinant Human Matriptase/ST14 (MT-SP1) Catalytic Domain (R&D Systems, Inc., 3946-SE-010) in Example 5-3. 5 types of heavy chains shown in FIG. 8 were designed. Expression vectors encoding the heavy chain variants EEIVHC002 (SEQ ID NO: 23), EEIVHC003 (SEQ ID NO: 24), EEIVHC004 (SEQ ID NO: 25), EEIVHC005 (SEQ ID NO: 26), and EEIVHC006 (SEQ ID NO: 27) were prepared by a method known to those skilled in the art.

IgG1 antibodies EEIVHC002/EEIVL (heavy chain: SEQ ID NO: 23, light chain: SEQ ID NO: 2), EEIVHC003/EEIVL (heavy chain: SEQ ID NO: 24, light chain: SEQ ID NO: 2), EEIVHC004/EEIVL (heavy chain: SEQ ID NO: 25, light chain: SEQ ID NO: 2), EEIVHC005/EEIVL (heavy chain: SEQ ID NO: 26, light chain: SEQ ID NO: 2), and EEIVHC006/EEIVL (heavy chain: SEQ ID NO: 27, light chain: SEQ ID NO: 2) harboring the protease cleavage sequence near the boundary between the heavy chain variable region and constant region were expressed by transient expression using these heavy chain variants in combination with a natural light chain and using FreeStyle 293 (Life Technologies Corp.) by a method known to those skilled in the art, and purified by a method known to those skilled in the art using protein A.

Figure 9:
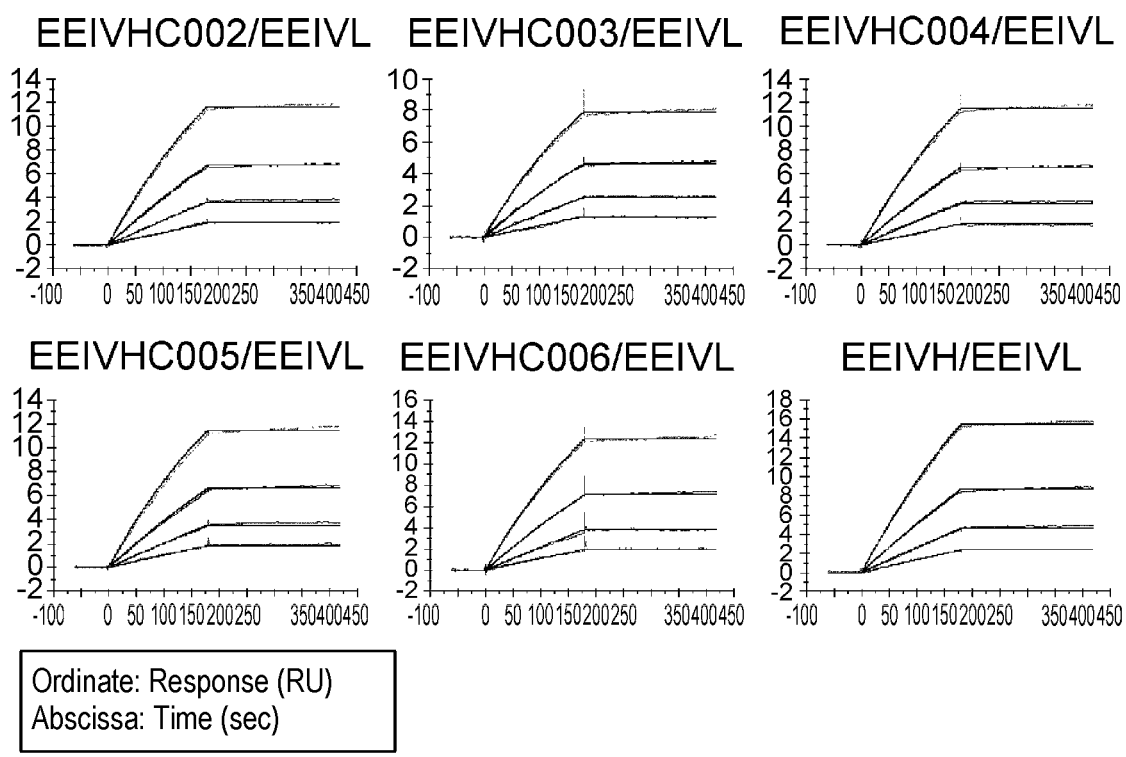
FIG. 9 is a diagram showing results of evaluating the interaction of human CXCL10 with each antibody molecule prepared by inserting a protease cleavage sequence and a flexible linker sequence near the boundary between the heavy chain variable region and constant region of MabCXCL10, using Biacore.
Figure 10A:
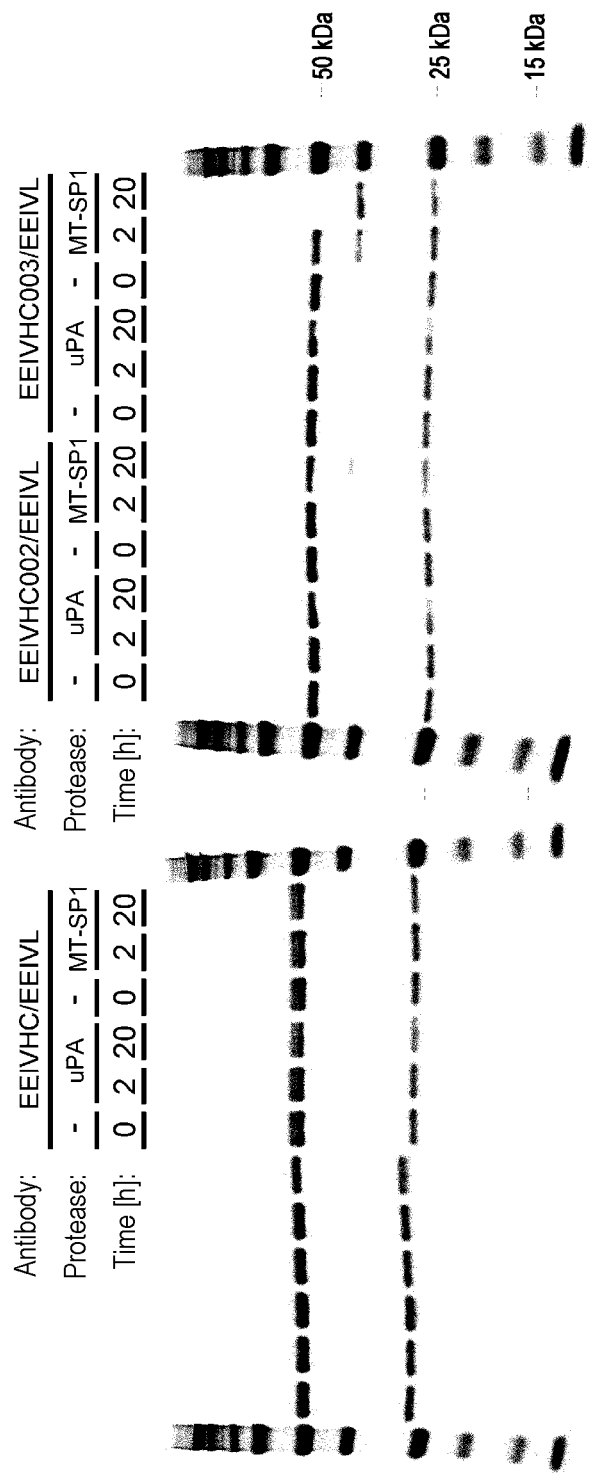
FIG. 10A is a diagram showing results of evaluating the degree of cleavage by migration in reducing SDS-PAGE and detection with CBB after protease (uPA or MT-SP1) treatment of antibody molecules prepared by inserting a protease cleavage sequence and a linker sequence near the boundary between the heavy chain variable region and constant region of MabCXCL10. Of two new bands resulting from the protease treatment, the band appearing around 15 kDa is a band derived from the VH, and the band appearing around 25 to 50 kDa is a band derived from the constant region.
Figure 10B:
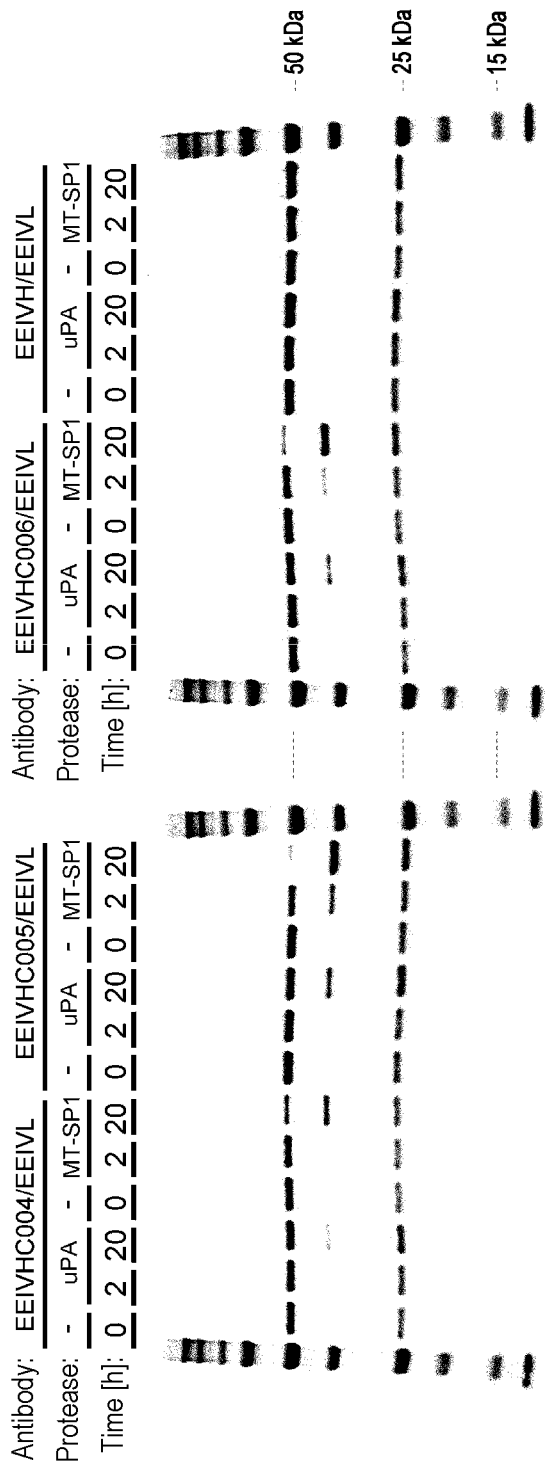
FIG. 10B is a diagram showing a continuation of FIG. 10A.

5-5. Binding Activity Evaluation of Anti-CXCL10 Neutralizing Antibody Harboring Protease Cleavage Sequence and Flexible Linker Sequence The antibodies prepared in Example 5-4 were evaluated for their interaction with human CXCL10 (266-IP-010/CF, R&D Systems, Inc.) using Biacore. The results are shown in FIG. 9. Specifically, R PROTEIN A (SURE) (28-4018-60, GE Healthcare Japan Corp.) was immobilized onto CM3 sensor chip (BR100536, GE Healthcare Japan Corp.) by the amine coupling method using NHS.EDC. The running buffer used was 20 mM ACES, 0.05% Tween 20, and 300 mM NaCl (pH 7.4). 6.25, 3.125, 1.563, or 0.781 nM human CXCL10 was injected thereto as an analyte with each antibody captured, and the binding of the antibody to the antigen was evaluated at 25° C. Sensorgrams showing profiles of SPR response plotted against time s after blank subtraction using an analyte consisting only of the running buffer are shown in FIG. 9. The start time of analyte injection was plotted as a starting point on the abscissa. When the response at the start time of analyte injection was defined as 0, a response at each point in time was plotted on the ordinate. As shown in the sensorgrams of FIG. 9, all the antibodies bound to the human CXCL10. Thus, the protease cleavage sequence and the flexible linker sequence were able to be inserted near the boundary between the antibody variable region and constant region without losing antigen binding activity.

Figure 11A:
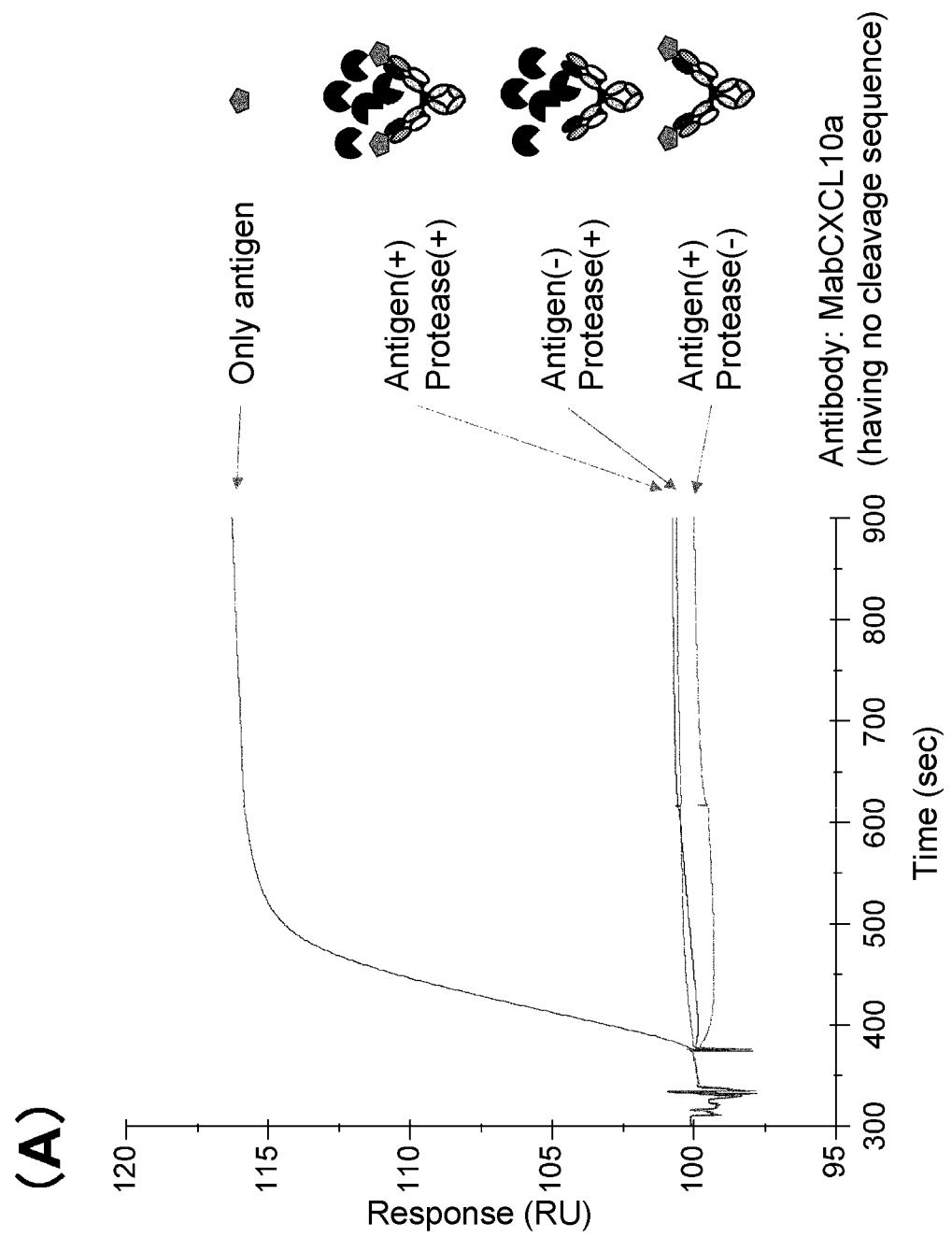
FIG. 11A is a diagram showing results of evaluating whether CXCL10 would be released by the protease (MT-SP1) treatment of a complex of MabCXCL10a and the CXCL10.
Figure 11B:
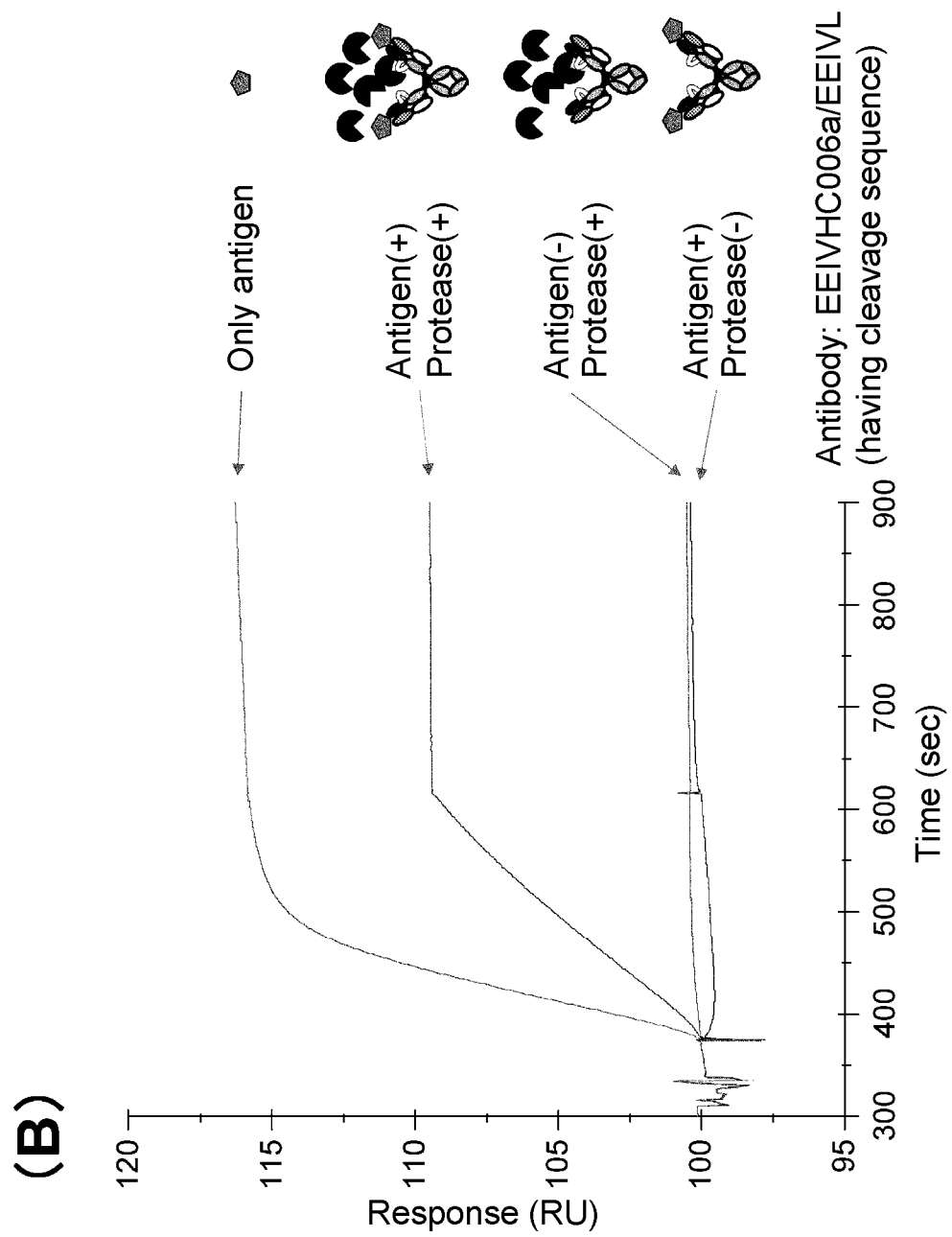
FIG. 11B is a diagram showing results of evaluating whether CXCL10 would be released by the protease (MT-SP1) treatment of a complex of EEIVHC006a/EEIVL and the CXCL10.

5-6. Protease Cleavage Evaluation of Anti-CXCL10 Neutralizing Antibody Harboring Protease Cleavage Sequence and Flexible Linker Sequence Whether the antibodies prepared in Example 5-5 would be cleaved by protease was verified. Human urokinase (uPA) (R&D Systems, Inc., 1310-SE-010) or recombinant Human Matriptase/ST14 Catalytic Domain (MT-SP1) (R&D Systems, Inc., 3946-SE-010) was used as the protease. 12.5 nM protease and 133 μg/mL of each antibody were reacted in PBS under a condition of 37° C. for 2 or 20 hours. Then, cleavage by the protease was evaluated by reducing SDS-PAGE. The results are shown in FIG. 10. As a result, the protease treatment of EEIVHC002/EEIVL, EEIVHC003/EEIVL, EEIVHC004/EEIVL, EEIVHC005/EEIVL, and EEIVHEC006/EEIVL generated a new band between 25 kDa and 50 kDa. Thus, the antibodies EEIVHC002/EEIVL, EEIVHC003/EEIVL, EEIVHC004/EEIVL, EEIVHC005/EEIVL, and EEIVHEC006/EEIVL were confirmed to be cleaved by protease.

These results demonstrated that even an antibody, such as EEIVHC/EEIVL, which does not undergo protease cleavage when harboring a protease cleavage site alone near the boundary between variable and constant regions can be prepared into a protease-cleavable molecule by introducing a flexible linker sequence in the vicinity of the cleavage sequence. The results described above demonstrated that an antibody that undergoes protease cleavage can also be prepared by arbitrarily combining a protease cleavage sequence with a flexible linker.

5-7. Ligand Activation by Protease Cleavage of CXCL10-Anti-CXCL10 Neutralizing Antibody Whether human CXCL10 bound with the antibody prepared in Example 5-5 would be released by protease treatment was then evaluated using Biacore. Specifically, the antibody EEIVHC006a/EEIVL (heavy chain: SEQ ID NO: 33, light chain: SEQ ID NO: 2) prepared in Example 5-5 was used to provide an antigen(+)/protease(+) analyte, an antigen(−)/protease(+) analyte, and an antigen(+)/protease(−) analyte. The antigen(+)/protease(+) analyte used was the antibody bound with human CXCL10 and then treated with 20 nM recombinant Human Matriptase/ST14 Catalytic Domain (MT-SP1) (R&D Systems, Inc., 3946-SE-010) for 20 hours. The antigen(−)/protease(+) analyte used was the antibody alone treated with 20 nM recombinant Human Matriptase/ST14 Catalytic Domain (MT-SP1) (R&D Systems, Inc., 3946-SE-010) for 20 hours. The antigen(+)/protease(−) analyte used was the antibody bound with human CXCL10. For a control of a system confirming responses based on the binding of CXCL10, CXCL10 was also provided as an analyte consisting only of the antigen. An anti-CXCL10 antibody was immobilized onto CMS sensor chip (BR100530, GE Healthcare Japan Corp.) by a method known to those skilled in the art. The running buffer used was 20 mM ACES and 0.05% Tween 20 (pH 7.4). Four types of analytes, i.e., the antigen(+)/protease(+) analyte, the antigen(−)/protease(+) analyte, the antigen(+)/protease(−) analyte, and only the antigen, were each injected thereto, and the binding of the human CXCL10 to the anti-CXCL10 antibody on the sensor chip was evaluated at 25° C.

MabCXCL10a (heavy chain: EEIVHa (SEQ ID NO: 65), light chain: EEIVL (SEQ ID NO: 2)) having the same Fab region as that of the antibody MabCXCL10 having no protease cleavage sequence was used to provide an antigen (+)/protease(+) analyte, an antigen(−)/protease(+) analyte, and an antigen(+)/protease(−) analyte in the same way as in the antibody EEIVHC006a/EEIVL. Similarly, an anti-CXCL10 antibody was immobilized onto CMS sensor chip (BR100530, GE Healthcare Japan Corp.) by a method known to those skilled in the art. The running buffer used was 20 mM ACES and 0.05% Tween 20 (pH 7.4). Four types of analytes, i.e., the antigen(+)/protease(+) analyte, the antigen(−)/protease(+) analyte, the antigen(+)/protease(−) analyte, and only the antigen (CXCL10), were each injected thereto, and the binding of the human CXCL10 to the anti-CXCL10 antibody on the sensor chip was evaluated at 25° C.

Sensorgrams showing profiles of SPR response plotted against time after subtraction using anti-CXCL10 antibody-unimmobilized flow cells are shown in FIG. 11. The start time of analyte injection was plotted as a starting point on the abscissa. When the response at the start time of analyte injection was defined as 100, a response at each point in time was plotted on the ordinate. As a result, as shown in FIG. 11(A), CXCL10 was not released by the protease treatment of MabCXCL10a harboring no cleavage sequence. By contrast, as shown in FIG. 11(B), CXCL10 was confirmed to be released by the protease treatment of EIVHC006a/EEIVL. 5-8. Preparation of Anti-CXCL10 Neutralizing Antibody by Replacing a Portion of Amino Acid Sequence Near Boundary Between Antibody Variable Region and Constant Region with a Portion of Protease Cleavage Sequence and Flexible Linker Sequence, and Protease Cleavage Evaluation Study was conducted to replace a portion of the amino acid sequence near the boundary between the heavy chain variable region and constant region of MabCXCL10 with a portion of a protease cleavage sequence and a flexible linker sequence. Heavy chains shown in FIG. 12 were designed such that partial amino acids of the heavy chains were replaced with peptide sequence A (SEQ ID NO: 3), a reported sequence cleavable by cancer-specifically expressed urokinase (uPA) and matriptase (MT-SP1). Expression vectors encoding the heavy chain variants EESVHA009 (SEQ ID NO: 59) and EESVHA012 (SEQ ID NO: 60) were prepared by a method known to those skilled in the art.

IgG1 antibodies EESVHA009/EEIVL (heavy chain: SEQ ID NO: 59, light chain: SEQ ID NO: 2) and EESVHA012/EEIVL (heavy chain: SEQ ID NO: 60, light chain: SEQ ID NO: 2) were expressed by transient expression using these heavy chain variants in combination with a natural light chain and using FreeStyle 293 (Life Technologies Corp.) by a method known to those skilled in the art, and purified by a method known to those skilled in the art using protein A.

Figure 13:
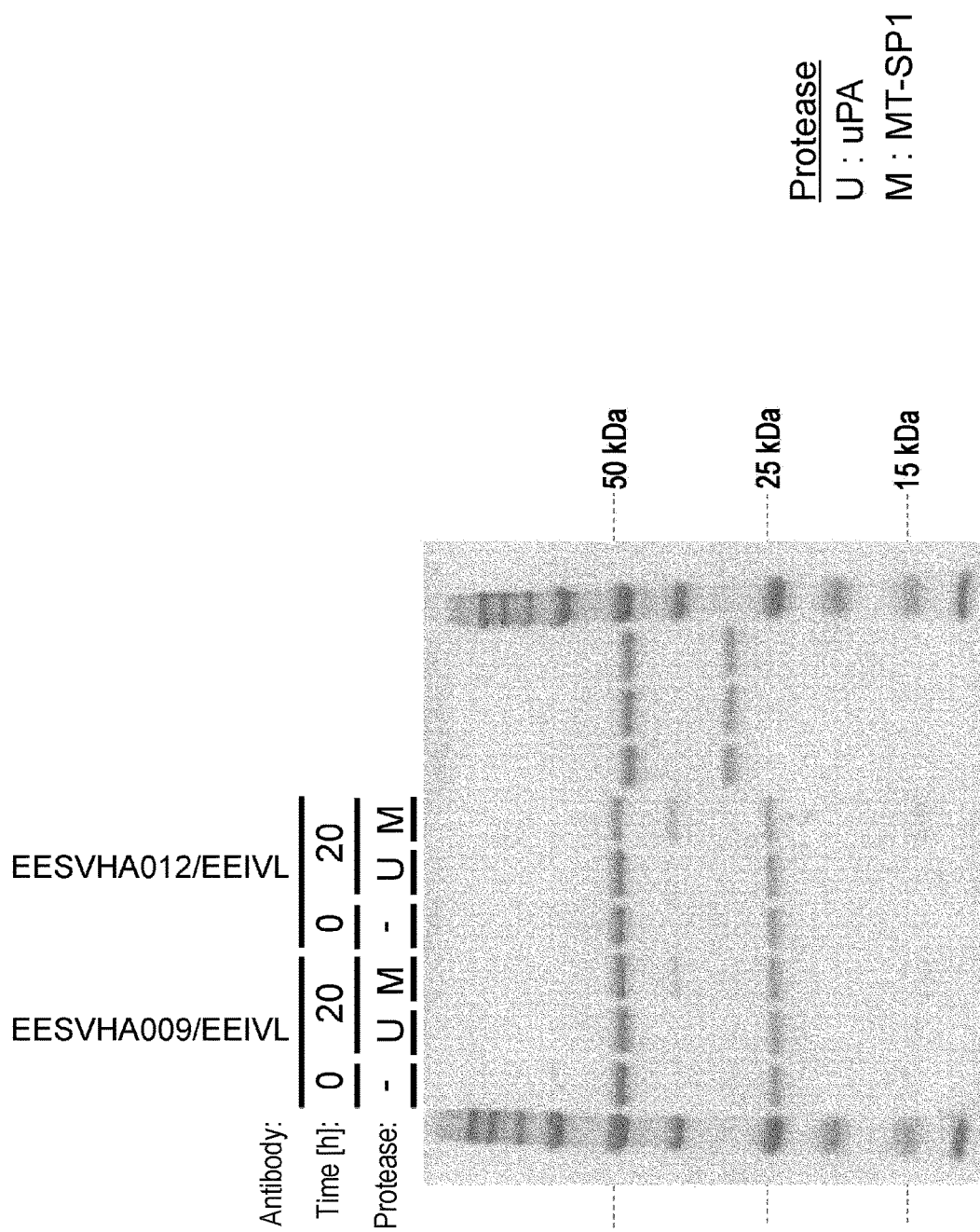
FIG. 13 is a diagram showing results of evaluating the degree of cleavage by migration in reducing SDS-PAGE and detection with CBB after protease (uPA or MT-SP1) treatment of antibody molecules prepared by substituting a portion of an amino acid sequence near the boundary between the variable and constant regions of MabCXCL10 by a protease cleavage sequence and a flexible linker. Of two new bands resulting from the protease treatment, the band appearing around 15 kDa is a band derived from the VH, and the band appearing around 25 to 50 kDa is a band derived from the constant region.

Whether EESVHA009/EEIVL and EESVHA012/EEIVL would be cleaved by protease was verified. Human urokinase (uPA) (R&D Systems, Inc., 1310-SE-010) or recombinant Human Matriptase/ST14 Catalytic Domain (MT-SP1) (R&D Systems, Inc., 3946-SE-010) was used as the protease. 12.5 nM protease and 100 µg/mL of each antibody were reacted in PBS under a condition of 37° C. for 20 hours. Then, cleavage by the protease was evaluated by reducing SDS-PAGE. The results are shown in FIG. 13. As a result, the protease treatment of EESVHA009/EEIVL and EESVHA012/EEIVL generated a new band between 25 kDa and 50 kDa. Thus, the antibodies EESVHA009/EEIVL and EESVHA012/EEIVL were confirmed to be cleaved by protease.

Example 6 Discussion on Acceptable Site for Insertion of Cleavage Sequence for Eliminating Antigen Binding Capacity by Protease Cleavage There is a report on the preparation and in vitro functional evaluation of an antibody harboring a protease cleavage sequence immediately before heavy chain aspartic acid at position 216 of a human IgG1 antibody (International Publication No. WO2004/021861A2). The report does not describe experimental data, but claims that after mixing of this antibody with its antigen, the antigen is released from the antigen-antibody complex by treatment with a medium containing appropriate protease.

The heavy chain amino acid at position 216 of a human IgG1 antibody claimed in the report to receive the insertion of the protease cleavage sequence is not aspartic acid in any of the Kabat numbering, EU numbering, and OU numbering systems described in Kabat, E. et al., Sequences of Proteins of Immunological Interest 5th edition. On the other hand, the heavy chain amino acid position 216 of a human IgG1 antibody seems to be aspartic acid immediately after cysteine forming a disulfide bond between the heavy and light chains, with reference to other literatures (Nature 344, 667-670 (12 Apr. 1990); and Kabat, E. et al. Sequences of Proteins of Immunological Interest 4th edition). In the case of inserting the protease cleavage sequence immediately before this aspartic acid at position 216, the resulting antibody that has undergone protease cleavage is considered to form the same Fab regions as those when the antibody hinge region is cleaved by papain. It is generally recognized that the papain cleavage of the antibody hinge region is unlikely to abolish the antigen binding capacity. Hence, it is suggested that this antibody harboring the protease cleavage sequence immediately before aspartic acid at position 216 does not lose its antigen binding capacity even if cleaved by appropriate protease.

Discussion will also be made on the case where the protease cleavage sequence is inserted immediately before heavy chain amino acid position 216 (Kabat numbering) of a human IgG1 antibody defined by the Kabat numbering described in Kabat, E. et al., Sequences of Proteins of Immunological Interest 5th edition. This site exists on the N-terminal side by several amino acids with respect to cysteine at position 220 (Kabat numbering) forming a disulfide bond between the heavy and light chains. Therefore, the influence of protease cleavage of the heavy chain at this site is presumably similar to the influence of deletion of the disulfide bond formed between the heavy and light chains. From the past reference, even a Fab region incapable of forming a disulfide bond between the heavy and light chains is unlikely to lose its antigen binding (MAbs. 2014 January-February; 6 (1): 204-18). Hence, it is suggested that the antibody does not lose its antigen binding capacity by protease cleavage even if the protease cleavage sequence is inserted immediately before heavy chain amino acid position 216 (Kabat numbering) of a human IgG1 antibody defined by the Kabat numbering described in Kabat, E. et al., Sequences of Proteins of Immunological Interest 5th edition.

Example 7 Evaluation of Chemotactic Activity Associated with Protease Cleavage of Anti-CXCL10 Neutralizing Antibody/CXCL10 Complex Harboring Protease Cleavage Sequence Whether a complex formed by CXCL10 and the CXCL10 neutralizing antibody harboring the protease cleavage sequence, prepared in Example 5 would release the CXCL10 by protease cleavage so that the CXCL10 would exert cell chemotactic activity, was evaluated.

The cell chemotactic activity of CXCL10 was evaluated by preparing Ba/F3 transfectant cells expressing mouse CXCR3 (mCXCR3) (hereinafter, referred to as BaF3/mCXCR3) and using these cells and HTS Transwell™-96 Permeable Support with 5.0 µm Pore Polycarbonate Membrane (Cat. 3387, Corning Inc.). 5 types of analytes were provided: CXCL10+protease, EEIVHC006a/EEIVL+CXCL10, EEIVHC006a/EEIVL+CXCL10+protease, EEIVHC006a/EEIVL+protease, and MabCXCL10+CXCL10+protease. Either 10 µg/mL (final concentration) of each antibody (MabCXCL10 or EEIVHC006a/EEIVL) or 100 ng/mL (final concentration) of hCXCL10 (Cat. 300-12, PeproTech, Inc.), or both the antibody and hCXCL10 were placed in Proteosave SS 1.5 mL microtube (Cat. MS-4265M, Sumitomo Bakelite Co., Ltd.) and left at ordinary temperature for 30 minutes. For the analytes with protease, after the reaction, mouse MT-SP1 (mMT-SP1, Cat. 4735-SE-010, R&D Systems, Inc.) was further added thereto at a final concentration of 12.5 nM.

Figure 14:
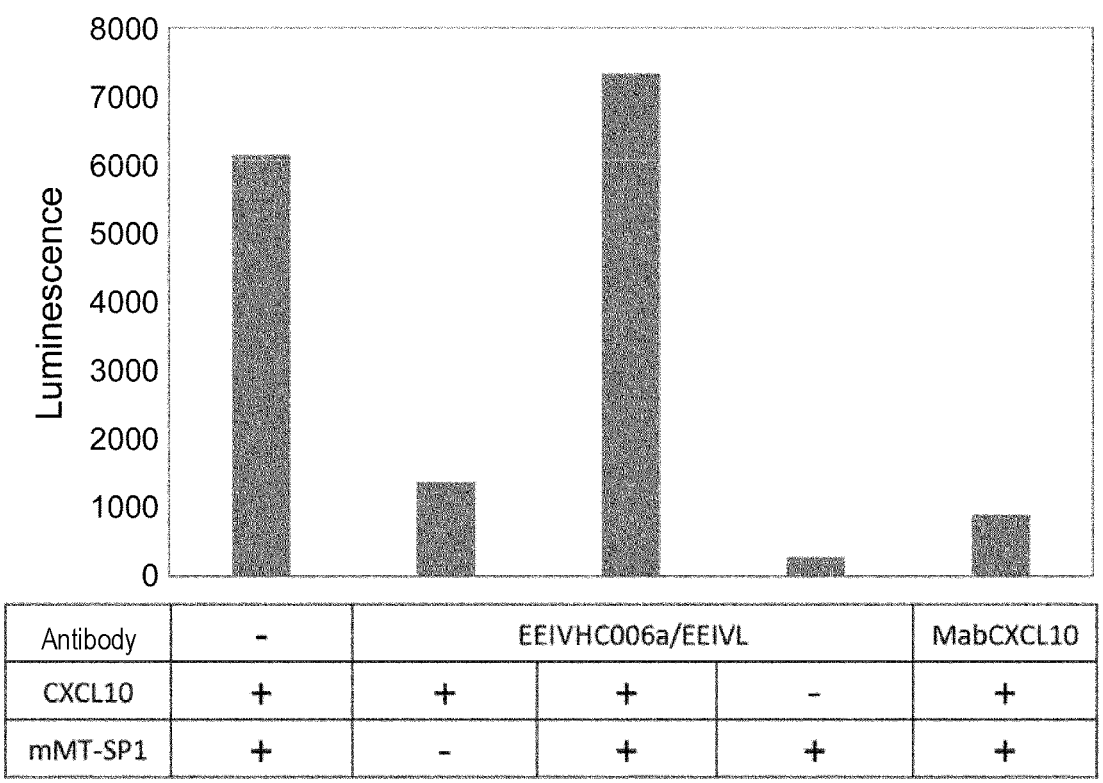
FIG. 14 is a diagram showing luciferase activity (luminescence intensity).
Figure 15:
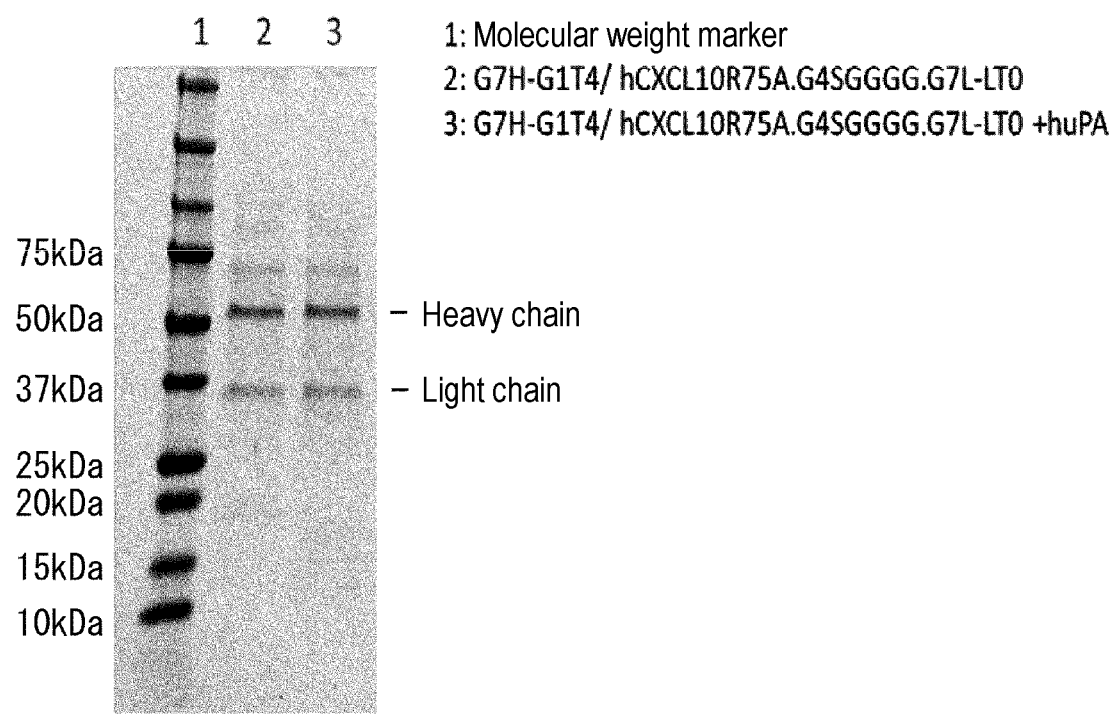
FIG. 15 shows results of SDS-PAGE before and after protease cleavage of a CXCL10-anti-CXCL10 antibody fusion protein.
Figure 16:
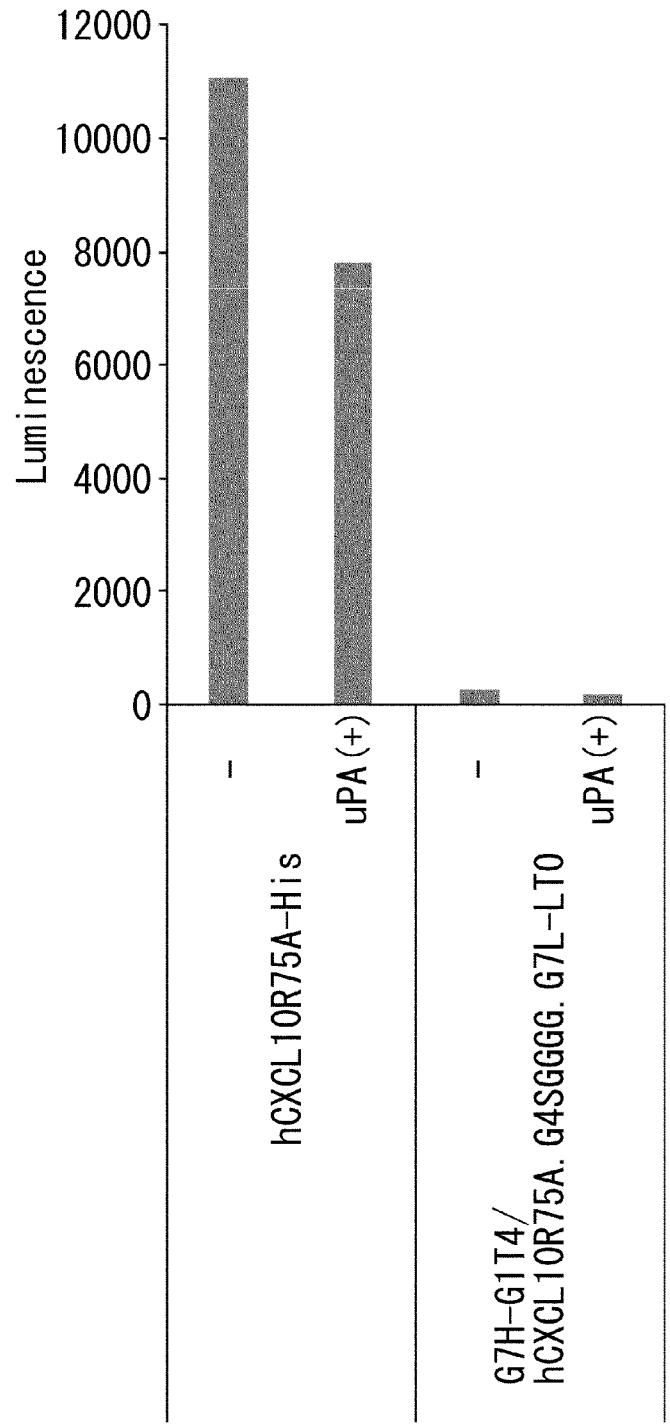
FIG. 16 is a diagram showing luciferase activity (luminescence intensity).

235 µL of each analyte was transferred to the lower chamber, and 2.0×10$^5$ cells/well of the BaF3/mCXCR3 cells were inoculated at 75 µL/well to the upper chamber, followed by reaction for 6 hours. The reaction was performed under conditions involving 5% $CO_2$ and 37° C. After the 6-hour reaction, 100 µL of the solution in the lower chamber was transferred to Fluorescence Luminescence 96-well plate (Cat. 3912, Corning Inc.), and 100 µL of CellTiter-Glo™ Luminescent Cell Viability Assay solution (Cat. G7571, Promega Corp.) was added thereto. After reaction at room temperature for 10 minutes, luminescence intensity was measured using SpectraMax M3 multimode microplate reader (Molecular Devices, LLC) to evaluate the degree of cell migration to the lower chamber. The results are shown in FIG. 14.

The luminescence intensity was decreased by the addition of the EEIVHC006a/EEIVL+CXCL10 analyte as compared with the CXCL10+protease analyte. The luminescence intensity reflects the amount of cells that have migrated. Hence, EEIVHC006a/EEIVL was found to form a complex with CXCL10 and neutralize the effect of the CXCL10. On the other hand, the luminescence intensity recovered by the addition of the EEIVHC006a/EEIVL+CXCL10+protease analyte compared with the addition of the EEIVHC006a/EEIVL+CXCL10 analyte, demonstrating that the addition of this analyte caused cell migration as in the addition of the CXCL10+protease analyte. No recovery was seen in luminescence intensity when the MabCXCL10+CXCL10+protease analyte containing the MabCXCL10 antibody having no cleavage sequence was added. This result demonstrated that the ability of EEIVHC006a/EEIVL to neutralize CXCL10 is reduced in association with the protease cleavage of the antibody.

Example 8 Evaluation of Chemotactic Activity Associated with Protease Cleavage of Anti-CXCL10 Neutralizing Antibody-CXCL10 Fusion Protein Harboring Protease Cleavage Sequence 8-1 Preparation and Protease Cleavage Evaluation of Anti-CXCL10 Neutralizing Antibody-CXCL10 Fusion Protein A ligand-fused light chain hCXCL10R75A.G4SGGGG.G7L-LT0 (SEQ ID NO: 371) was designed by using the light chain of MabCXCL10_G7 (heavy chain: G7H-G1T4 (SEQ ID NO: 368), light chain: G7L-LT0 (SEQ ID NO: 369)), a neutralizing antibody against human CXCL10, and fused with a human CXCL10 mutant hCXCL10R75A (SEQ ID NO: 370) having a protease resistance mutation via a linker sequence consisting of a glycine-serine polymer to the N terminus of the light chain. A fusion protein G7H-G1T4/hCXCL10R75A.G4SGGGG.G7L-LT0 (heavy chain: SEQ ID NO: 368, ligand-fused light chain: SEQ ID NO: 371) was expressed by transient expression using the ligand-fused light chain in combination of the heavy chain G7H-G1T4 of MabCXCL10_G7 and using Expi293 (Life Technologies Corp.) by a method known to those skilled in the art, and purified by a method known to those skilled in the art using protein A. MabCXCL10_G7 had the following CDR sequences: H-CDR1 (SFSIT; SEQ ID NO: 374), H-CDR2 (EITPMFGIANYAQKFQG; SEQ ID NO: 375), H-CDR3 (DGRFDVSDLLTDKPKVTINYNGMDV; SEQ ID NO: 376), L-CDR1 (SGSSSNIGSNTVN; SEQ ID NO: 377), L-CDR2 (NNDQRPS; SEQ ID NO: 378), and L-CDR3 (ASWDDSLNGRV; SEQ ID NO: 379).

Whether this fusion protein would be cleaved by protease was verified. Human-derived urokinase (human uPA, huPA) (R&D Systems, Inc., 1310-SE-010) was used as the protease. The cleavage of the fusion protein by the protease was evaluated by reducing SDS-PAGE. 0.1 mg/ml of the fusion protein was reacted with 30 nM huPA at 37° C. for 1 hour. Then, the cleavage of the fusion protein was evaluated by reducing SDS-PAGE. As a result, G7H-G1T4/hCXCL10R75A.G4SGGGG.G7L-LTO was not cleaved by protease treatment (FIG. 15).

8-2 Evaluation of Chemotactic Activity Associated with Protease Cleavage of Anti-CXCL10 Neutralizing Antibody-CXCL10 Fusion Protein Whether the anti-CXCL10 neutralizing antibody-CXCL10 fusion protein containing CXCL10 fused with the anti-CXCL10 neutralizing antibody harboring the protease cleavage sequence would release the CXCL10 by protease cleavage to cause cell migration, was evaluated.

For a reference to be compared with the activity of hCXCL10R75A released from the fusion protein, hCXCL10R75A-His (SEQ ID NO: 373) exhibiting the activity of only hCXCL10R75A was prepared and purified by the following method: a human CXCL10 mutant hCXCL10R75A (SEQ ID NO: 370) having a protease resistance mutation was C-terminally histidine-tagged to prepare a histidine-tagged human CXCL10 mutant hCXCL10R75A-His (SEQ ID NO: 373). hCXCL10R75A-His (SEQ ID NO: 373) was expressed by transient expression using Expi293 (Life Technologies Corp.) by a method known to those skilled in the art, and purified by a method known to those skilled in the art using nickel Sepharose.

The cell chemotactic activity was evaluated by preparing Ba/F3 transfectant cells expressing mouse CXCR3 (mCXCR3) (hereinafter, referred to as BaF3/mCXCR3), and using these cells and HTS Transwell™-96 Permeable Support with 5.0 µm Pore Polycarbonate Membrane (Cat. 3387, Corning Inc.).

Recombinant huPA (Cat. 1310-SE, R&D Systems, Inc.) was added at a final concentration of 30 nM to 0.15 µg/mL of hCXCL10R75A-His or 1.5 µg/mL of the fusion protein G7H-G1T4/hCXCL10R75A.G4SGGGG.G7L-LTO having no protease cleavage sequence in 2.0 mL 96-well deep well plate (Cat. P-DW-20-C-S, AxyGen Scientific, Inc.) to provide uPA(+) analytes. 1.5 µg/mL of G7H-G1T4/hCXCL10R75A.G4SGGGG.G7L-LTO contained hCXCL10R75A in an amount corresponding to 0.15 µg/mL. 0.15 µg/mL of hCXCL10R75A-His and 1.5 µg/mL of the fusion protein G7H-G1T4/hCXCL10R75A.G4SGGGG.G7L-LTO having no protease cleavage sequence were used as uPA(−) analytes.

235 µL of each solution to be analyzed was transferred to the lower chamber, and $2.0\times10^5$ cells/well of the BaF3/mCXCR3 cells were inoculated at 75 µL/well to the upper chamber, followed by reaction for 6 hours. The reaction was performed under conditions involving 5% $CO_2$ and 37° C. After the 6-hour reaction, 100 µL of the solution in the lower chamber was transferred to OptiPlate-96 (Cat. 6005299, PerkinElmer, Inc.), and 100 µL of CellTiter-Glo™ Luminescent Cell Viability Assay solution (Cat. G7571, Promega Corp.) was added thereto. After reaction at room temperature for 10 minutes, luminescence intensity was measured using SpectraMax M3 multimode microplate reader (Molecular Devices, LLC) to evaluate the degree of cell migration to the lower chamber. The results are shown in FIG. 16. No recovery was seen in luminescence intensity when the G7H-G1T4/hCXCL10R75A.G4SGGGG.G7L-LTO having no cleavage sequence was treated with protease, as compared with the addition of CXCL10R75A-His.

8-3 Construction of Anti-CXCL10 Neutralizing Antibody-CXCL10 Fusion Protein Harboring Protease Cleavage Sequence and Evaluation of Chemotactic Activity Associated with Protease Cleavage An amino acid sequence is designed such that the protease cleavage sequence is contained near the boundary between the variable and constant regions of the ligand-fused light chain hCXCL10R75A.G4SGGGG.G7L-LTO (SEQ ID NO: 371) constructed in Example 8-1. A fusion protein is expressed by transient expression using the ligand-fused light chain harboring the protease cleavage sequence in combination with the heavy chain G7H-G1T4 of MabCXCL10_G7 and using Expi293 (Life Technologies Corp.) by a method known to those skilled in the art, and purified by a method known to those skilled in the art using protein A.

Whether this fusion protein is cleaved by protease is verified. Human-derived urokinase (human uPA, huPA) (R&D Systems, Inc., 1310-SE-010) is used as the protease. The cleavage of the fusion protein by the protease is evaluated by reducing SDS-PAGE. 0.1 mg/ml of the fusion protein is reacted with 30 nM huPA at 37° C. for 1 hour. Then, the cleavage of the fusion protein is evaluated by reducing SDS-PAGE.

Whether the anti-CXCL10 neutralizing antibody-CXCL10 fusion protein containing CXCL10 fused with the anti-CXCL10 neutralizing antibody harboring the protease cleavage sequence releases the CXCL10 by protease cleavage to cause cell migration, is evaluated. The cell chemotactic activity is evaluated by preparing Ba/F3 transfectant cells expressing mouse CXCR3 (mCXCR3) (hereinafter, referred to as BaF3/mCXCR3), and using these cells and HTS Transwell™-96 Permeable Support with 5.0 μm Pore Polycarbonate Membrane (Cat. 3387, Corning Inc.).

Recombinant huPA (Cat. 1310-SE, R&D Systems, Inc.) is added at a final concentration of 30 nM to 0.15 μg/mL of hCXCL10R75A-His prepared in Example 8-2 or 1.5 μg/mL of the fusion protein harboring the protease cleavage sequence in 2.0 mL 96-well deep well plate (Cat. P-DW-20-C-S, AxyGen Scientific, Inc.) to provide uPA(+) analytes. 1.5 μg/mL of the fusion protein having the protease cleavage sequence contains hCXCL10R75A in an amount corresponding to 0.15 μg/mL. 0.15 μg/mL of hCXCL10R75A-His and 1.5 μg/mL of the fusion protein having the protease cleavage sequence are used as uPA(−) analytes.

235 μL of each solution to be analyzed is transferred to the lower chamber, and 2.0×10⁵ cells/well of the BaF3/mCXCR3 cells are inoculated at 75 μL/well to the upper chamber, followed by reaction for 6 hours. The reaction is performed under conditions involving 5% $CO_2$ and 37° C. After the 6-hour reaction, 100 μL of the solution in the lower chamber is transferred to OptiPlate-96 (Cat. 6005299, PerkinElmer, Inc.), and 100 μL of CellTiter-Glo™ Luminescent Cell Viability Assay solution (Cat. G7571, Promega Corp.) is added thereto. After reaction at room temperature for 10 minutes, luminescence intensity is measured using SpectraMax M3 multimode microplate reader (Molecular Devices, LLC) to evaluate the degree of cell migration to the lower chamber. The chemotactic activity can be evaluated on the basis of the luminescence intensity.

Example 9 Preparation of Anti-IL-12 Neutralizing Antibody Harboring Protease Cleavage Sequence and Flexible Linker Sequence and Evaluation of IL-12 Activation Associated with Protease Cleavage 9-1. Preparation of Anti-IL-12 Neutralizing Antibody Harboring Protease Cleavage Sequence and Flexible Linker Sequence IL-12 is a cytokine having an immunostimulatory effect. IL-12 activates immunocytes and thereby exerts an antitumor effect, while the systemic exposure of IL-12 has also been reported to cause severe adverse reactions (Nat Immunol. 2012 Jul. 19; 13 (8): 722-8).

UstkH-G1T4CYTM1inP1 (SEQ ID NO: 146) was designed as an heavy chain variant of ustekinumab, a neutralizing antibody against human IL-12, by inserting a sequence containing peptide sequence A (SEQ ID NO: 3) reportedly cleavable by urokinase (uPA) and matriptase (MT-SP1) and a flexible linker consisting of a glycine-serine polymer near the boundary between the variable and constant regions of the heavy chain (UstkH-G1T4, heavy chain: SEQ ID NO: 144) of an anti-IL12 antibody having the same variable region as that of ustekinumab. An expression vector encoding an ustekinumab antibody variant UstkH-G1T4CYTM1inP1/UstkL-kT0 (heavy chain: SEQ ID NO: 146, light chain: SEQ ID NO: 145) was prepared by a method known to those skilled in the art using the heavy chain variant in combination with the light chain (UstkL-kT0; SEQ ID NO: 145) of ustekinumab. This ustekinumab antibody variant UstkH-G1T4CYTM1inP1/UstkL-kT0 was expressed by transient expression using FreeStyle 293 (Life Technologies Corp.) by a method known to those skilled in the art, and purified by a method known to those skilled in the art using protein A. In this Example, the anti-IL12 antibody and its antibody variant contained the following CDR sequences: H-CDR1 (TYWLG; SEQ ID NO: 386), H-CDR2 (IMSPVDSDIRYSPSFQG; SEQ ID NO: 387), H-CDR3 (RRPGQGYFDF; SEQ ID NO: 388), L-CDR1 (RASQGISSWLA; SEQ ID NO: 389), L-CDR2 (AASSLQS; SEQ ID NO: 390), and L-CDR3 (QQYNIYPYT; SEQ ID NO: 391).

9-2. Protease Cleavage of Anti-IL-12 Neutralizing Antibody Harboring Protease Cleavage Sequence and Flexible Linker Sequence Whether the antibody prepared in Example 9-1 would be cleaved by protease was verified. Human-derived recombinant Human Matriptase/ST14 Catalytic Domain (human MT-SP1, hMT-SP1) (R&D Systems, Inc., 3946-SE-010), mouse-derived recombinant Mouse Matriptase/ST14 Catalytic Domain (mouse MT-SP1, mMT-SP1) (R&D Systems, Inc., 4735-SE-010), or human-derived urokinase (human uPA, huPA) (R&D Systems, Inc., 1310-SE-010) was used as the protease. For protease treatment, hMT-SP1, mMT-SP1, or huPA was added at a final concentration of 10.1, 16.9, or 9.17 μM to ustekinumab (UstkH-G1T4/UstkL-kT0) or the ustekinumab antibody variant UstkH-G1T4CYTM1inP1/UstkL-kT0, followed by overnight reaction at 37° C.

Figure 17:
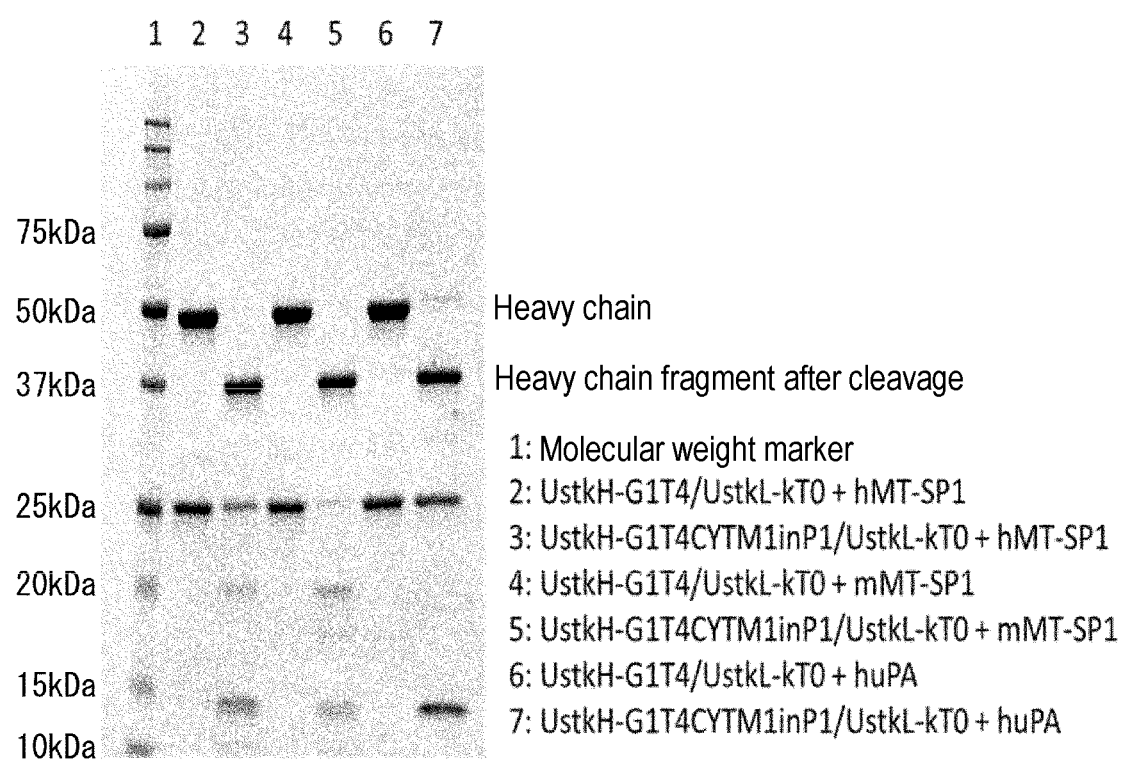
FIG. 17 is a diagram showing reducing SDS-PAGE results of evaluating the protease cleavage of anti-IL-12 neutralizing antibodies harboring a protease cleavage sequence and a flexible linker sequence.

9-3. Confirmation of Cleavage of Cleaved Anti-IL-12 Neutralizing Antibody Harboring Protease Cleavage Sequence and Flexible Linker Sequence and Evaluation of IL-12 Activation The protease cleavage of the antibody was evaluated by reducing SDS-PAGE. As a result, UstkH-G1T4/UstkL-kT0 did not undergo cleavage by each protease, whereas each protease treatment of UstkH-G1T4CYTM1inP1/UstkL-kT0 harboring the protease cleavage sequence and the flexible linker generated a new band between 25 kDa and 50 kDa (FIG. 17). Thus, the anti-IL-12 neutralizing antibody (UstkH-G1T4CYTM1inP1/UstkL-kT0) harboring the protease cleavage sequence and the flexible linker sequence was confirmed to be cleaved by protease.

Figure 18:
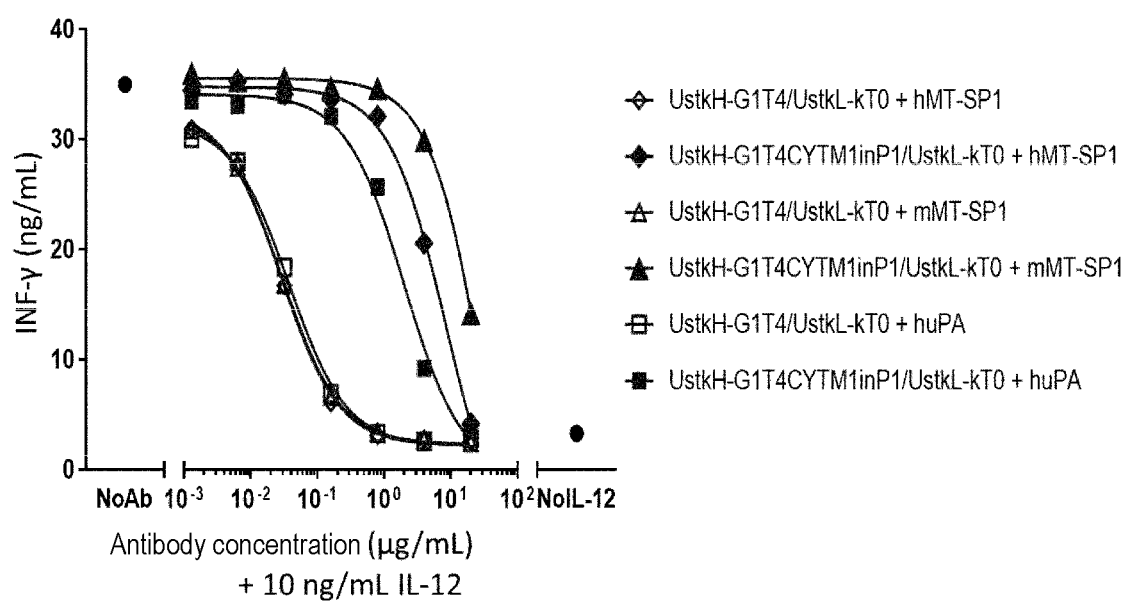
FIG. 18 is a diagram showing the production of interferon gamma when IL-12 and an antibody were added. NoAb represents a sample supplemented with only IL-12 without being supplemented with an antibody, and NoIL-12 represents a sample supplemented with neither IL-12 nor an antibody.

Next, whether IL-12 would be released from its complex with the antibody by the protease cleavage of the antibody to exert physiological activity, was evaluated. The physiological activity of IL-12 was evaluated on the basis of the IFN-γ (also referred to as interferon gamma or IFN-g) production of a human cell line NK92. The NK92 cells were inoculated at $1\times10^5$ cells/well to a 96-well cell culture plate. 10 ng/mL of IL-12 and the protease-treated antibody (UstkH-G1T4/UstkL-kT0 or UstkH-G1T4CYTM1inP1/UstkL-kT0; concentration of each antibody: 20, 4, 0.8, 0.16, 0.032, 0.0054, and 0.0013 μg/mL) were added thereto. 48 hours later, the amount of IFN-γ produced was measured by ELISA. In order to evaluate the influence of the antibody on IL12 activity, an experiment (No Ab) was also conducted by the addition of only protease-treated IL12 without the addition of an antibody. FIG. 18 shows the results of measuring the concentration of interferon gamma. UstkH-G1T4/UstkL-kT0 (having no protease cleavage sequence) treated with each protease suppressed (or neutralized) the production of interferon gamma by IL-12, and 0.8 μg/mL of the antibody suppressed the interferon gamma production to the same level as in the absence of IL-12 (No IL-12). On the other hand, UstkH-G1T4CYTM1inP1/UstkL-kT0 (containing the protease cleavage sequence) treated with each protease resulted in interferon gamma production at all antibody concentrations, as compared with the addition of UstkH-G1T4/UstkL-kT0 having no protease cleavage sequence. From this result, UstkH-G1T4CYTM1inP1/UstkL-kT0 was confirmed to allow IL-12 to act on cells, through the attenuation of its ability to neutralize IL-12 in association with protease cleavage.

Example 10 Evaluation of Antibody Harboring Protease Cleavage Sequence in Anti-Human CXCL10 Neutralizing Antibody 10-1. Introduction of Protease Cleavage Sequence to Anti-Human CXCL10 Neutralizing Antibody Expression vectors of CXCL10 neutralizing antibodies MabCXCL10 (heavy chain: EEIVH (SEQ ID NO: 1), light chain: EEIVL (SEQ ID NO: 2)) and MabCXCL10_G7 (heavy chain: G7H-G1T4 (SEQ ID NO: 368), light chain: G7L-LT0 (SEQ ID NO: 369)) were prepared by a method known to those skilled in the art, and expressed using FreeStyle 293 cells (Invitrogen Corp.) or Expi293 cells (Life Technologies Corp.) and purified by methods known to those skilled in the art.

A cleavage sequence shown in SEQ ID NO: 345 was inserted near the boundary between the heavy chain variable region and constant region of MabCXCL10 or MabCXCL10_G7 to prepare a MabCXCL10 heavy chain variant EldHA0003-G1T4 (SEQ ID NO: 356) and a MabCXCL10_G7 heavy chain variant G7H.12aa-G1T4 (SEQ ID NO: 367).

An MabCXCL10 antibody variant EldHA0003 (heavy chain: SEQ ID NO: 356, light chain: SEQ ID NO: 2) and an MabCXCL10_G7 antibody variant G7H.12aa (heavy chain: SEQ ID NO: 367, light chain: SEQ ID NO: 369) were expressed by transient expression using these two types of heavy chain variants in combination with a light chain and using FreeStyle 293 cells (Invitrogen Corp.) or Expi293 cells (Life Technologies Corp.) by a method known to those skilled in the art, and purified by a method known to those skilled in the art using protein A.

Figure 19A:
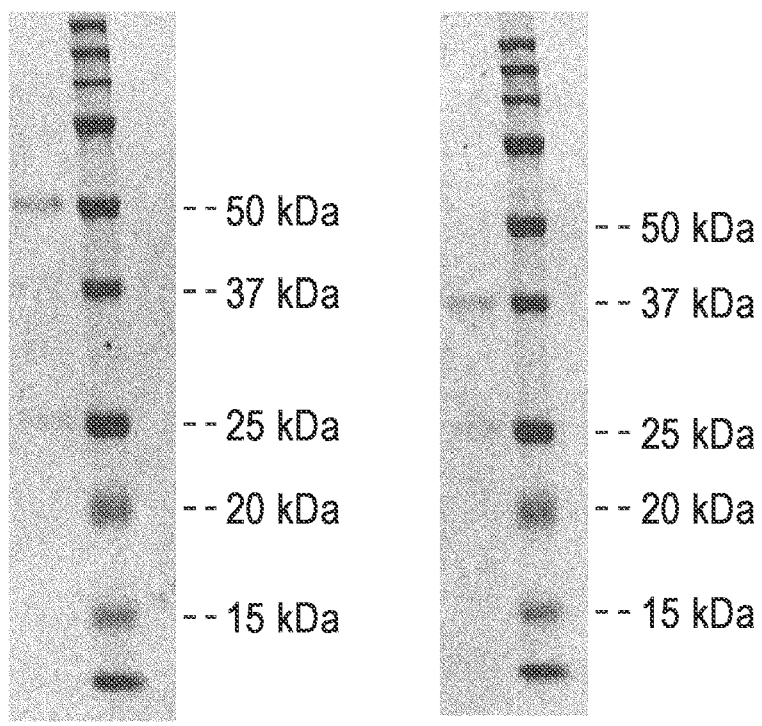
Figure 19B:
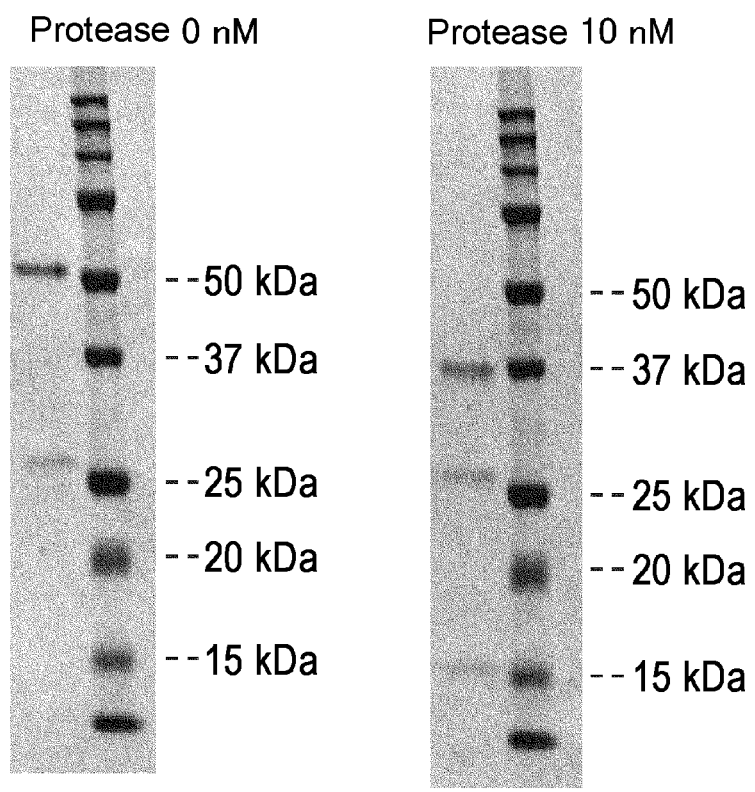

10-2. Protease Cleavage Evaluation of Anti-Human CXCL10 Neutralizing Antibody Harboring Protease Cleavage Sequence in its Heavy Chain Region Whether the antibodies prepared in Example 10-1 would be cleaved by protease was verified. Recombinant Human Matriptase/ST14 Catalytic Domain (human MT-SP1, hMT-SP1) (R&D Systems, Inc., 3946-SE-010) was used as the protease. 10 nM protease and 50 μg/mL of each antibody were reacted in PBS under a condition of 37° C. for 20 hours, followed by reducing SDS-PAGE. The results are shown in FIGS. 19A and 19B. The hMT-SP1 treatment of the MabCXCL10 antibody variant EldHA0003 or the MabCXCL10_G7 antibody variant G7H.12aa generated a new band around 37 kDa. Thus, the protease cleavage sequence shown in SEQ ID NO: 345 was confirmed to be cleaved by hMT-SP1. Also, the protease cleavage sequence shown in SEQ ID NO: 345 was confirmed by a similar method to be cleaved by human uPA and mouse uPA.

Example 11 Preparation and Evaluation of Polypeptides Harboring Diverse Protease Cleavage Sequences 11-1 Preparation of Polypeptides Harboring Recognition Sequences for Diverse Proteases An expression vector of MRA (heavy chain: MRAH-G1T4 (SEQ ID NO: 147), light chain: MRAL-k0 (SEQ ID NO: 148)), a neutralizing antibody against human IL6R, was prepared by a method known to those skilled in the art. MRA had the following CDR sequences: H-CDR1 (SDHAWS; SEQ ID NO: 398), H-CDR2 (YISYSGITTYNPSLKS; SEQ ID NO: 399), H-CDR3 (SLARTTAMDY; SEQ ID NO: 400), L-CDR1 (RASQDISSYLN; SEQ ID NO: 401), L-CDR2 (YTSRLHS; SEQ ID NO: 402), and L-CDR3 (QQGNTLPYT; SEQ ID NO: 403).

Table 1 shows peptide sequences known to be cleaved by MMP-2, MMP-7, or MMP-9 and peptide sequences containing a flexible linker consisting of a glycine-serine polymer in the vicinity of these sequences.

TABLE 1

| Protease | Inserted sequence | SEQ ID NO |
|---|---|---|
| MMP-2 MMP-9 | PLGLAG | 34 |
| MMP-2 | GAGIPVSLRSGAG | 70 |
| MMP-2 | GPLGIAGQ | 71 |
| MMP-2 | GGPLGMLSQS | 72 |
| MMP-2 | PLGLWA | 73 |
| MMP-7 | VPLSLTMG | 35 |
| MMP-7 | GAGVPLSLTMGAG | 75 |
| MMP-9 | GAGVPLSLYSGAG | 76 |
| MMP-2 MMP-9 | GGGGSPLGLAGGGGGS | 149 |

TABLE 1-continued

| Protease | Inserted sequence | SEQ ID NO |
|---|---|---|
| MMP-2 | GGGGSGPLGIAGQGGGGS | 150 |
| MMP-2 | GGGGSPLGLWAGGGGS | 151 |
| MMP-9 | GGGGSGAGVPLSLYSGAGGGGS | 152 |

Heavy chain variants MEIVHG4SMP2MP9G4S-MEIVHG4SMP2MP9G4SG1T4 (SEQ ID NO: 153), MEIVHG4SMP2.2G4S-MEIVHG4SMP2.2G4SG1T4 (SEQ ID NO: 154), MEIVHG4SMP2.4G4S-MEIVHG4SMP2.4G4SG1T4 (SEQ ID NO: 155), MEIVHG4SMP9G4S-MEIVHG4SMP9G4SG1T4 (SEQ ID NO: 156), MEIVHMP2.1-MEIVHMP2.1G1T4 (SEQ ID NO: 157), MEIVHMP2.3-MEIVHMP2.3G1T4 (SEQ ID NO: 158), and MEIVHMP7.2-MEIVHMP7.2G1T4 (heavy chain: SEQ ID NO: 159) were designed such that these inserted sequences were contained in near the boundary between the heavy chain variable region and constant region of the MRA antibody. Expression vectors encoding these heavy chain variants were prepared by a method known to those skilled in the art.

MRA antibody variants shown in Table 2 were expressed by transient expression using these heavy chain variants in combination with the MRA light chain and using FreeStyle 293 cells (Invitrogen Corp.) or Expi293 cells (Life Technologies Corp.) by a method known to those skilled in the art, and purified by a method known to those skilled in the art using protein A.

TABLE 2

MRA antibody variants

| Protease | Antibody name | SEQ ID NO of heavy chain | SEQ ID NO of light chain |
|---|---|---|---|
| MMP-2 | MEIVHG4SMP2MP9G4S-MEICHG4SMP2MP9G4SG1T4/MRAL-k0 | 153 | 148 |
| MMP-2 | MEIVHG4SMP2.2G4S-MEICHG4SMP2.2G4SG1T4/MRAL-k0 | 154 | 148 |
| MMP-2 | MEIVHG4SMP2.4G4S-MEICHG4SMP2.4G4S6G1T4/MRAL-k0 | 155 | 148 |
| MMP-9 | MEIVHG4SMP2MP9G4S-MEICHG4SMP2MP9G4SG1T4/MRAL-K0 | 153 | 148 |
| MMP-9 | MEIVHG4SMP9G4S-MEICHG4SMP9G4SG1T4/MRAL-k0 | 156 | 148 |
| MMP-2 | MEIVHMP2.1-MEIVHMP2.1G1T4/MRAL-k0 | 157 | 148 |
| MMP-2 | MEIVHMP2.3-MEIVHMP2.3G1T4/MRAL-k0 | 158 | 148 |
| MMP-7 | MEIVHMP7.2-MEIVHMP7.2G1T4/MRAL-k0 | 159 | 148 |

Figure 20A:
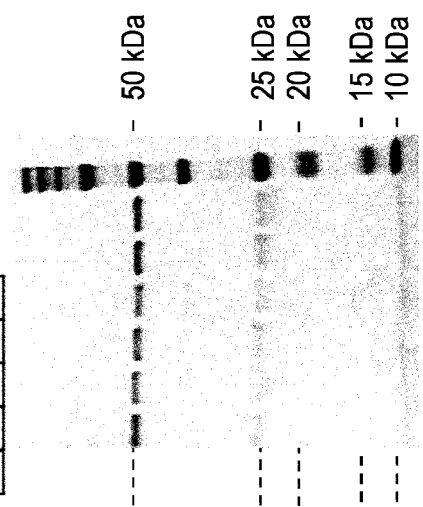
Figure 20B:
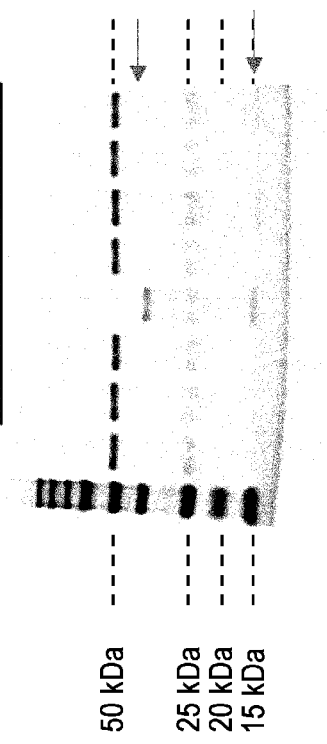

2. Protease Cleavage Evaluation of Polypeptides Harboring Recognition Sequences for Diverse Proteases Whether the MRA antibody variants prepared in Example 11-1 would be cleaved by protease was verified. Recombinant human MMP-2 (R&D Systems, Inc., 902-MP-010), recombinant human MMP-7 (R&D Systems, Inc., 907-MP-010), or recombinant human MMP-9 (R&D Systems, Inc., 911-MP-010) was used as the protease. Each protease was used after being mixed with 1 mM p-aminophenylmercuric acetate (APMA; Abcam PLC, ab112146) and activated at 37° C. for 1 or 24 hours. 50 nM, 100 nM, or 500 nM protease and 50 µg/mL of each antibody were reacted in an assay buffer (MMP Activity Assay Kit (Fluorometric—Green) (ab112146), Component C: Assay Buffer) or 20 mM Tris-HCl, 150 mM NaCl, and 5 mM $CaCl_2$) (pH 7.2) (hereinafter, referred to as Tris) under a condition of 37° C. for 20 hours. Then, cleavage by the protease was evaluated by reducing SDS-PAGE. The results are shown in FIGS. 20A, 20B, and 21. The MRA antibody variants were each reacted with the protease shown in Table 2. The cleavage by MMP-2 was observed in MEIVHG4SMP2MP9G4S-MEIVHG4SMP2MP9G4SG1T4/MRAL-k0, MEIVHG4SMP2.2G4S-MEIVHG4SMP2.2G4SG1T4/MRAL-k0, MEIVHG4SMP2.4G4S-MEIVHG4SMP2.4G4SG1T4/MRAL-k0, MEIVHMP2.1-MEIVHMP2.1G1T4/MRAL-k0, and MEIVHMP2.3-MEIVHMP2.3G1T4/MRAL-k0. The cleavage by MMP-7 was observed in MEIVHMP7.2-MEIVHMP7.2G1T4/MRAL-k0. The cleavage by MMP-9 was observed in MEIVHG4SMP2MP9G4S-MEIVHG4SMP2MP9G4SG1T4/MRAL-k0 and MEIVHG4SMP9G4S-MEIVHG4SMP9G4SG1T4/MRAL-k0.

Example 12 Evaluation of Antibodies Harboring Protease Cleavage Sequence at Diverse Positions of Heavy Chain 12-1 Preparation of Antibodies Harboring Protease Cleavage Sequence at Diverse Positions of Heavy Chain Peptide sequence B (SEQ ID NO: 160) reportedly cleavable by urokinase (uPA) and matriptase (MT-SP1) was inserted at each of different positions within a MRA heavy chain variable region (MRAH; SEQ ID NO: 161) to prepare MRA heavy chain variable region variants shown in Table 3. These MRA heavy chain variable region variants were each fused with a MRA heavy chain constant region (G1T4; SEQ ID NO: 162) to prepare MRA heavy chain variants. The corresponding gene expression vectors were prepared by a method known to those skilled in the art. Also, peptide sequence B (SEQ ID NO: 160) was inserted at each of different positions within a MRA heavy chain constant region (G1T4; SEQ ID NO: 162) to prepare MRA heavy chain constant region variants shown in Table 4. These MRA heavy chain constant region variants were each fused with a MRA heavy chain variable region (MRAH; SEQ ID NO: 161) to prepare MRA heavy chain variants. The corresponding gene expression vectors were prepared by a method known to those skilled in the art. Tables 3 and 4 also show the protease cleavage sequence insertion positions in the prepared MRA heavy chain variable region variants and MRA heavy chain constant region variants. In Table 3, the inserted sequence was located adjacent on the constant region side to the described position (Kabat numbering) in the antibody heavy chain variable region. In Table 4, the inserted sequence was located adjacent on the variable region side to the described position (EU numbering) in the antibody heavy chain constant region.

TABLE 3

MRA heavy chain variable region variants and protease cleavage sequence insertion positions

| MRA heavy chain variable region variant | Protease cleavage sequence insertion position (Kabat numbering) | SEQ ID NO |
|---|---|---|
| MRAVH007.12aa | 7 | 163 |
| MRAVH008.12aa | 8 | 164 |
| MRAVH009.12aa | 9 | 165 |
| MRAVH010.12aa | 10 | 166 |
| MRAVH011.12aa | 11 | 167 |
| MRAVH012.12aa | 12 | 168 |
| MRAVH013.12aa | 13 | 169 |
| MRAVH014.12aa | 14 | 170 |
| MRAVH015.12aa | 15 | 171 |
| MRAVH041.12aa | 40 | 172 |
| MRAVH042.12aa | 41 | 173 |
| MRAVH043.12aa | 42 | 174 |
| MRAVH044.12aa | 43 | 175 |
| MRAVH045.12aa | 44 | 176 |
| MRAVH046.12aa | 45 | 177 |
| MRAVH056.12aa | 55 | 178 |
| MRAVH057.12aa | 56 | 179 |
| MRAVH058.12aa | 57 | 180 |
| MRAVH059.12aa | 58 | 181 |
| MRAVH060.12aa | 59 | 182 |
| MRAVH061.12aa | 60 | 183 |
| MRAVH062.12aa | 61 | 184 |
| MRAVH063.12aa | 62 | 185 |
| MRAVH064.12aa | 63 | 186 |
| MRAVH065.12aa | 64 | 187 |
| MRAVH066.12aa | 65 | 188 |
| MRAVH067.12aa | 66 | 189 |
| MRAVH068.12aa | 67 | 190 |
| MRAVH069.12aa | 68 | 191 |
| MRAVH074.12aa | 73 | 192 |
| MRAVH075.12aa | 74 | 193 |
| MRAVH076.12aa | 75 | 194 |
| MRAVH077.12aa | 76 | 195 |
| MRAVH078.12aa | 77 | 196 |
| MRAVH087.12aa | 83 | 197 |
| MRAVH088.12aa | 84 | 198 |
| MRAVH089.12aa | 85 | 199 |
| MRAVH099.12aa | 95 | 200 |
| MRAVH100.12aa | 96 | 201 |
| MRAVH101.12aa | 97 | 202 |
| MRAVH102.12aa | 98 | 203 |
| MRAVH109.12aa | 103 | 204 |
| MRAVH110.12aa | 104 | 205 |
| MRAVH111.12aa | 105 | 206 |
| MRAVH112.12aa | 106 | 207 |
| MRAVH113.12aa | 107 | 208 |
| MRAVH114.12aa | 108 | 209 |
| MRAVH115.12aa | 109 | 210 |
| MRAVH116.12aa | 110 | 211 |
| MRAVH117.12aa | 111 | 212 |
| MRAVH118.12aa | 112 | 213 |
| MRAVH119.12aA | 113 | 214 |

TABLE 4

MRA heavy chair, constant region variants and protease cleavage sequence insertion positions

| MRA heavy chain constant region variant | Protease cleavage sequence, insertion position (EU numbering) | SEQ ID NO |
|---|---|---|
| G1T4.118.12aa | 119 | 215 |
| G1T4.119.12aa | 120 | 216 |
| G1T4.120.12aa | 121 | 217 |
| G1T4.121.12aa | 122 | 218 |
| G1T4.122.12aa | 123 | 219 |
| G1T4.123.12aa | 124 | 220 |
| G1T4.124.12aa | 125 | 221 |
| G1T4.129.12aa | 130 | 222 |
| G1T4.130.12aa | 131 | 223 |
| G1T4.131.12aa | 132 | 224 |
| G1T4.132.12aa | 133 | 225 |
| G1T4.134.12aa | 135 | 226 |
| G1T4.135.12aa | 136 | 227 |
| G1T4.137.12aa | 138 | 228 |
| G1T4.139..12aa | 140 | 229 |

MRA antibody variants shown in Table 5 were expressed by transient expression using the MRA heavy chain variants thus prepared in combination with the MRA light chain and using FreeStyle 293 cells (Invitrogen Corp.) or Expi293 cells (Life Technologies Corp.) by a method known to those skilled in the art, and purified by a method known to those skilled in the art using protein A.

TABLE 5

MRA antibody variants

| Antibody name | SEQ ID NO of heavy | SEQ ID NO of light |
|---|---|---|
| MRAVH007.12aa-G1T4/MRAL-k0 | 404 | 148 |
| MRAVH008.12aa-G1T4/MRAL-k0 | 405 | 148 |
| MRAVH009.12aa-G1T4/MRAL-k0 | 406 | 148 |
| MRAVH010.12aa-G1T4/MRAL-k0 | 407 | 148 |
| MRAVH011.12aa-G1T4/MRAL-k0 | 408 | 148 |
| MRAVH012.12aa-G1T4/MRAL-k0 | 409 | 148 |
| MRAVH013.12aa-G1T4/MRAL-k0 | 410 | 148 |
| MRAVH014.12aa-G1T4/MRAL-k0 | 411 | 148 |
| MRAVH015.12aa-G1T4/MRAL-k0 | 412 | 148 |
| MRAVH041.12aa-G1T4/MRAL-k0 | 413 | 148 |
| MRAVH042.12aa-G1T4/MRAL-k0 | 414 | 148 |
| MRAVH043.12aa-G1T4/MRAL-k0 | 415 | 148 |
| MRAVH044.12aa-G1T4/MRAL-k0 | 416 | 148 |
| MRAVH045.12aa-G1T4/MRAL-k0 | 417 | 148 |
| MRAVH046.12aa-G1T4/MRAL-k0 | 418 | 148 |
| MRAVH056.12aa-G1T4/MRAL-k0 | 419 | 148 |
| MRAVH057.12aa-G1T4/MRAL-k0 | 420 | 148 |
| MRAVH058.12aa-G1T4/MRAL-k0 | 421 | 148 |
| MRAVH059.12aa-G1T4/MRAL-k0 | 422 | 148 |
| MRAVH060.12aa-G1T4/MRAL-k0 | 423 | 148 |
| MRAVH061.12aa-G1T4/MRAL-k0 | 424 | 148 |
| MRAVH062.12aa-G1T4/MRAL-k0 | 425 | 148 |
| MRAVH063.12aa-G1T4/MRAL-k0 | 426 | 148 |
| MRAVH064.12aa-G1T4/MRAL-k0 | 427 | 148 |
| MRAVH065.12aa-G1T4/MRAL-k0 | 428 | 148 |
| MRAVH066.12aa-G1T4/MRAL-k0 | 429 | 148 |
| MRAVH067.12aa-G1T4/MRAL-k0 | 430 | 148 |
| MRAVH068.12aa-G1T4/MRAL-k0 | 431 | 148 |
| MRAVH069.12aa-G1T4/MRAL-k0 | 432 | 148 |
| MRAVH074.12aa-G1T4/MRAL-k0 | 433 | 148 |
| MRAVH075.12aa-G1T4/MRAL-k0 | 434 | 148 |
| MRAVH076.12aa-G1T4/MRAL-k0 | 435 | 148 |
| MRAVH077.12aa-G1T4/MRAL-k0 | 436 | 148 |
| MRAVH078.12aa-G1T4/MRAL-k0 | 437 | 148 |
| MRAVH087.12aa-G1T4/MRAL-k0 | 438 | 148 |
| MRAVH088.12aa-G1T4/MRAL-k0 | 439 | 148 |
| MRAVH089.12aa-G1T4/MRAL-k0 | 440 | 148 |
| MRAVH099.12aa-G1T4/MRAL-k0 | 441 | 148 |
| MRAVH100.12aa-G1T4/MRAL-k0 | 442 | 148 |
| MRAVH101.12aa-G1T4/MRAL-k0 | 443 | 148 |
| MRAVH102.12aa-G1T4/MRAL-k0 | 444 | 148 |
| MRAVH109.12aa-G1T4/MRAL-k0 | 445 | 148 |
| MRAVH110.12aa-G1T4/MRAL-k0 | 446 | 148 |
| MRAVH111.12aa-G1T4/MRAL-k0 | 447 | 148 |

TABLE 5-continued

MRA antibody variants

| Antibody name | SEQ ID NO of heavy | SEQ ID NO of light |
|---|---|---|
| MRAVH112.12aa-G1T4/MRAL-k0 | 448 | 148 |
| MRAVH113.12aa-G1T4/MRAL-k0 | 449 | 148 |
| MRAVH114.12aa-G1T4/MRAL-k0 | 450 | 148 |
| MRAVH115.12aa-G1T4/MRAL-k0 | 451 | 148 |
| MRAVH116.12aa-G1T4/MRAL-k0 | 452 | 148 |
| MRAVH117.12aa-G1T4/MRAL-k0 | 453 | 148 |
| MRAVH118.12aa-G1T4/MRAL-k0 | 454 | 148 |
| MRAVH119.12aa-G1T4/MRAL-k0 | 455 | 148 |
| MRAH-G1T4.118.12aa/MRAL-k0 | 456 | 148 |
| MRAH-G1T4.119.12aa/MRAL-k0 | 457 | 148 |
| MRAH-G1T4.120.12aa/MRAL-k0 | 458 | 148 |
| MRAH-G1T4.121.12aa/MRAL-k0 | 459 | 148 |
| MRAH-G1T4.122.12aa/MRAL-k0 | 460 | 148 |
| MRAH-G1T4.123.12aa/MRAL-k0 | 461 | 148 |
| MRAH-G1T4.124.12aa/MRAL-k0 | 462 | 148 |
| MRAH-G1T4.129.12aa/MRAL-k0 | 463 | 148 |
| MRAH-G1T4.130.12aa/MRAL-k0 | 464 | 148 |
| MRAH-G1T4.131.12aa/MRAL-k0 | 465 | 148 |
| MRAH-G1T4.132.12aa/MRAL-k0 | 466 | 148 |
| MRAH-G1T4.134.12aa/MRAL-k0 | 467 | 148 |
| MRAH-G1T4.135.12aa/MRAL-k0 | 468 | 148 |
| MRAH-G1T4.137.12aa/MRAL-k0 | 469 | 148 |
| MRAH-G1T4.139.12aa/MRAL-k0 | 470 | 148 |

12-2. Protease Cleavage Evaluation of Anti-Human IL6R Neutralizing Antibody Harboring Protease Cleavage Sequence in its Antibody Heavy Chain Whether the MRA antibody variants prepared in Example 12-1 would be cleaved by protease was verified. Recombinant Human Matriptase/ST14 Catalytic Domain (human MT-SP1, hMT-SP1) (R&D Systems, Inc., 3946-SE-010) was used as the protease. 10 nM protease and 50 pg/mL of each antibody were reacted in PBS under a condition of 37° C. for 20 hours, followed by reducing SDS-PAGE. The results are shown in FIGS. 22A, 22B, 22C, 22D, 22E, 22F, 22G, 22H, 22I, 23A, 23B, and 23C. The protease-treated MRA antibody variants underwent cleavage at their heavy chains and generated a heavy chain band at a position with a smaller molecular weight than that of the heavy chains of protease-untreated MRA antibody variants (in the drawings, a band appearing around 50 kDa in the MT-SP1(−) lane). From this result, the MRA antibody variants prepared in Example 12-1 were confirmed to be cleaved by hMT-SP1.

Example 13 Evaluation of Antibodies Harboring Protease Cleavage Sequence at Diverse Positions of Light Chain 13-1 Preparation of Antibodies Harboring Protease Cleavage Sequence at Diverse Positions of Light Chain Peptide sequence B (SEQ ID NO: 160) reportedly cleavable by urokinase (uPA) and matriptase (MT-SP1) was inserted at each of different positions within a MRA light chain variable region (MRAL; SEQ ID NO: 230) to prepare MRA light chain variable region variants shown in Table 6. These MRA light chain variable region variants were each fused with a MRA light chain constant region (k0; SEQ ID NO: 231) to prepare MRA light chain variants. The corresponding gene expression vectors were prepared by a method known to those skilled in the art. Also, peptide sequence B (SEQ ID NO: 160) was inserted at each of different positions within a MRA light chain constant region (k0; SEQ ID NO: 231) to prepare MRA light chain constant region variants shown in Table 70. These MRA light chain constant region variants were each fused with a MRA light chain variable region (MRAL; SEQ ID NO: 230) to prepare MRA light chain variants. The corresponding gene expression vectors were prepared by a method known to those skilled in the art. Tables 6 and 7 also show the protease cleavage sequence insertion positions in the prepared MRA light chain variable region variants and MRA light chain constant region variants. In Table 6, the inserted sequence was located adjacent on the constant region side to the described amino acid position (Kabat numbering) in the antibody light chain variable region. In Table 7, the inserted sequence was located adjacent on the variable region side to the described amino acid position (EU numbering) in the antibody light chain constant region.

TABLE 6

MRA light chain variable region variants and protease cleavage sequence insertion positions

| MRA light chain variable region variant | Protease cleavage sequence insertion position (Kabat numbering) | SEQ ID NO |
|---|---|---|
| MRAVL007.12aa | 7 | 232 |
| MRAVL008.12aa | 8 | 233 |
| MRAVL009.12aa | 9 | 234 |
| MRAVL010.12aa | 10 | 235 |
| MRAVL011.12aa | 11 | 236 |
| MRAVL012.12aa | 12 | 237 |
| MRAVL013.12aa | 13 | 238 |
| MRAVL014.12aa | 14 | 239 |
| MRAVL015.12aa | 15 | 240 |
| MRAVL016.12aa | 16 | 241 |
| MRAVL017.12aa | 17 | 242 |
| MRAVL018.12aa | 18 | 243 |
| MRAVL039.12aa | 39 | 244 |
| MRAVL040.12aa | 40 | 245 |
| MRAVL041.12aa | 41 | 246 |
| MRAVL042.12aa | 42 | 247 |
| MRAVL043.12aa | 43 | 248 |
| MRAVL044.12aa | 44 | 249 |
| MRAVL045.12aa | 45 | 250 |
| MRAVL049.12aa | 49 | 251 |
| MRAVL050.12aa | 50 | 252 |
| MRAVL051.12aa | 51 | 253 |
| MRAVL052.12aa | 52 | 254 |
| MRAVL053.12aa | 53 | 255 |
| MRAVL054.12aa | 54 | 256 |
| MRAVL055.12aa | 55 | 257 |
| MRAVL056.12aa | 56 | 258 |
| MRAVL057.12aa | 57 | 259 |
| MRAVL058.12aa | 58 | 260 |
| MRAVL059.12aa | 59 | 261 |
| MRAVL060.12aa | 60 | 262 |
| MRAVL096.12aa | 96 | 263 |
| MRAVL097.12aa | 97 | 264 |
| MRAVL098.12aa | 98 | 265 |
| MRAVL099.12aa | 99 | 266 |
| MRAVL100.12aa | 100 | 267 |
| MRAVL101.12aa | 101 | 268 |
| MRAVL102.12aa | 102 | 269 |
| MRAVL103.12aa | 103 | 270 |
| MRAVL104.12aa | 104 | 271 |
| MRAVL105.12aa | 105 | 272 |
| MRAVL106.12aa | 106 | 273 |
| MRAVL107.12aa | 107 | 274 |

TABLE 7

MRA light chain constant region variants and protease cleavage sequence insertion positions

| MRA light chain constant region variant | Protease cleavage sequence insertion position (EU numbering) | SEQ ID NO |
|---|---|---|
| k0.108.12aa | 109 (Kabat numbering position 109) | 275 |
| k0.109.12aa | 110 (Kabat numbering position 110) | 276 |
| k0.110.12aa | 111 (Kabat numbering position 111) | 277 |
| k0.111.12aa | 112 (Kabat numbering position 112) | 278 |
| k0.112.12aa | 113 (Kabat numbering position 113) | 279 |
| k0.113.12aa | 114 (Kabat numbering position 114) | 280 |
| k0.115.12aa | 116 (Kabat numbering position 116) | 281 |
| k0.116.12aa | 117 (Kabat numbering position 111) | 282 |
| k0.117.12aa | 118 (Kabat numbering position 118) | 283 |
| k0.118.12aa | 119 (Kabat numbering position 119) | 284 |
| k0.119.12aa | 120 (Kabat numbering position 120) | 285 |
| k0.120.12aa | 121 (Kabat numbering position 121) | 286 |
| k0.121.12aa | 122 (Kabat numbering position 122) | 287 |
| k0.122.12aa | 123 (Kabat numbering position 123) | 288 |
| k0.123.12aa | 124 (Kabat numbering position 124) | 289 |
| k0.124.12aa | 125 (Kabat numbering position 125) | 290 |
| k0.125.12aa | 126 (Kabat numbering position 126) | 291 |
| k0.126.12aa | 127 (Kabat numbering position 127) | 292 |
| k0.127.12aa | 128 (Kabat numbering position 128) | 293 |
| k0.128.12aa | 129 (Kabat numbering position 129) | 294 |
| k0.129.12aa | 130 (Kabat numbering position 130) | 295 |
| k0.130.12aa | 131 (Kabat numbering position 131) | 296 |

MRA antibody variants shown in Table 8 were expressed by transient expression using the MRA light chain variants thus prepared in combination with the MRA heavy chain and using FreeStyle 293 cells (Invitrogen Corp.) or Expi293 cells (Life Technologies Corp.) by a method known to those skilled in the art, and purified by a method known to those skilled in the art using protein A.

TABLE 8

MRA antibody variants

| Antibody name | SEQ ID NO of heavy chain | SEQ ID NO of light chain |
|---|---|---|
| MRAH-G1T4/MRAVL007.12aa-k0 | 147 | 471 |
| MRAH-G1T4/MRAVL008.12aa-k0 | 147 | 472 |
| MRAH-G1T4/MRAVL009.12aa-k0 | 147 | 473 |
| MRAH-G1T4/MRAVL010.12aa-k0 | 147 | 474 |
| MRAH-G1T4/MRAVL011.12aa-k0 | 147 | 475 |
| MRAH-G1T4/MRAVL012.12aa-k0 | 147 | 476 |
| MRAH-G1T4/MRAVL013.12aa-k0 | 147 | 477 |
| MRAH-G1T4/MRAVL014.12aa-k0 | 147 | 478 |
| MRAH-G1T4/MRAVL015.12aa-k0 | 147 | 479 |
| MRAH-G1T4/MRAVL016.12aa-k0 | 147 | 480 |
| MRAH-G1T4/MRAVL017.12aa-k0 | 147 | 481 |
| MRAH-G1T4/MRAVL018.12aa-k0 | 147 | 482 |
| MRAH-G1T4/MRAVL039.12aa-k0 | 147 | 483 |
| MRAH-G1T4/MRAVL040.12aa-k0 | 147 | 484 |
| MRAH-G1T4/MRAVL041.12aa-k0 | 147 | 485 |
| MRAH-G1T4/MRAVL042.12aa-k0 | 147 | 486 |
| MRAH-G1T4/MRAVL043.12aa-k0 | 147 | 487 |
| MRAH-G1T4/MRAVL044.12aa-k0 | 147 | 488 |
| MRAH-G1T4/MRAVL045.12aa-k0 | 147 | 489 |
| MRAH-G1T4/MRAVL049.12aa-k0 | 147 | 490 |
| MRAH-G1T4/MRAVL050.12aa-k0 | 147 | 491 |
| MRAH-G1T4/MRAVL051.12aa-k0 | 147 | 492 |
| MRAH-G1T4/MRAVL052.12aa-k0 | 147 | 493 |
| MRAH-G1T4/MRAVL053.12aa-k0 | 147 | 494 |
| MRAH-G1T4/MRAVL054.12aa-k0 | 147 | 495 |
| MRAH-G1T4/MRAVL055.12aa-k0 | 147 | 496 |
| MRAH-G1T4/MRAVL056.12aa-k0 | 147 | 497 |
| MRAH-G1T4/MRAVL057.12aa-k0 | 147 | 498 |
| MRAH-G1T4/MRAVL058.12aa-k0 | 147 | 499 |
| MRAH-G1T4/MRAVL059.12aa-k0 | 147 | 500 |
| MRAH-G1T4/MRAVL060.12aa-k0 | 147 | 501 |
| MRAH-G1T4/MRAVL096.12aa-k0 | 147 | 502 |
| MRAH-G1T4/MRAVL097.12aa-k0 | 147 | 503 |
| MRAH-G1T4/MRAVL098.12aa-k0 | 147 | 504 |
| MRAH-G1T4/MRAVL099.12aa-k0 | 147 | 505 |
| MRAH-G1T4/MRAVL100.12aa-k0 | 147 | 506 |
| MRAH-G1T4/MRAVL101.12aa-k0 | 147 | 507 |
| MRAH-G1T4/MRAVL102.12aa-k0 | 147 | 508 |
| MRAH-G1T4/MRAVL103.12aa-k0 | 147 | 509 |
| MRAH-G1T4/MRAVL104.12aa-k0 | 147 | 510 |
| MRAH-G1T4/MRAVL105.12aa-k0 | 147 | 511 |
| MRAH-G1T4/MRAVL106.12aa-k0 | 147 | 512 |
| MRAH-G1T4/MRAVL107.12aa-k0 | 147 | 513 |
| MRAH-G1T4/MRAL-k0.108.12aa | 147 | 514 |
| MRAH-G1T4/MRAL-k0.109.12aa | 147 | 515 |
| MRAH-G1T4/MRAL-k0.110.12aa | 147 | 516 |
| MRAH-G1T4/MRAL-k0.111.12aa | 147 | 517 |
| MRAH-G1T4/MRAL-k0.112.12aa | 147 | 518 |
| MRAH-G1T4/MRAL-k0.113.12aa | 147 | 519 |
| MRAH-G1T4/MRAL-k0.115.12aa | 147 | 520 |
| MRAH-G1T4/MRAL-k0.116.12aa | 147 | 521 |
| MRAH-G1T4/MRAL-k0.117.12aa | 147 | 522 |
| MRAH-G1T4/MRAL-k0.118.12aa | 147 | 523 |
| MRAH-G1T4/MRAL-k0.119.12aa | 147 | 524 |
| MRAH-G1T4/MRAL-k0.120.12aa | 147 | 525 |
| MRAH-G1T4/MRAL-k0.121.12aa | 147 | 526 |
| MRAH-G1T4/MRAL-k0.122.12aa | 147 | 527 |
| MRAH-G1T4/MRAL-k0.123.12aa | 147 | 528 |
| MRAH-G1T4/MRAL-k0.124.12aa | 147 | 529 |
| MRAH-G1T4/MRAL-k0.125.12aa | 147 | 530 |
| MRAH-G1T4/MRAL-k0.126.12aa | 147 | 531 |
| MRAH-G1T4/MRAL-k0.127.12aa | 147 | 532 |
| MRAH-G1T4/MRAL-k0.128.12aa | 147 | 533 |
| MRAH-G1T4/MRAL-k0.129.12aa | 147 | 534 |
| MRAH-G1T4/MRAL-k0.130.12aa | 147 | 535 |

13-2. Protease Cleavage Evaluation of Anti-Human IL6R Neutralizing Antibody Harboring Protease Cleavage Sequence in its Antibody Light Chain Variable Region Whether the MRA antibody variants prepared in Example 13-1 would be cleaved by protease was verified. Recombinant Human Matriptase/ST14 Catalytic Domain (MT-SP1) (R&D Systems, Inc., 3946-SE-010) was used as the protease. 10 nM protease and 50 μg/mL of each antibody were reacted in PBS under a condition of 37° C. for 20 hours, followed by reducing SDS-PAGE. The results are shown in FIGS. 24A, 24B, 24C, 24D, 24E, 25A, and 25B. The protease-treated MRA antibody variants underwent cleavage at their light chains and generated a light chain band at a position with a smaller molecular weight than that of the light chains of protease-untreated MRA antibody variants (in the drawings, a band appearing around 25 kDa in the MT-SP1(−) lane).

Example 14 Preparation and Human PD1 Binding Evaluation of Anti-Human PD1 Neutralizing Antibody Harboring Protease Cleavage Sequence 14-1. Introduction of Protease Cleavage Sequence to Anti-Human PD1 Neutralizing Antibody A protease cleavage sequence was inserted into the heavy or light chain of 5C4H-G1T4/5C4L-KTO (heavy chain: 5C4H-G1T4, SEQ ID NO: 297; heavy chain variable region: 5C4H, SEQ ID NO: 300; heavy chain constant region: G1T4, SEQ ID NO: 301; light chain: 5C4L-KTO, SEQ ID NO: 298; light chain variable region: 5C4L, SEQ ID NO: 302; light chain constant region: KTO, SEQ ID NO: 303; H-CDR1 (NSGMH, SEQ ID NO: 392), H-CDR2 (VIWYDGSKRYYADSVKG, SEQ ID NO: 393), H-CDR3

(NDDY, SEQ ID NO: 394), L-CDR1 (RASQSVSSYLA, SEQ ID NO: 395), L-CDR2 (DASNRAT, SEQ ID NO: 396), L-CDR3 (QQSSNWPRT, SEQ ID NO: 397)), a neutralizing antibody against human PD1, to prepare an antibody harboring the protease cleavage sequence.

First, a peptide sequence (SEQ ID NO: 299) reportedly cleavable by cancer-specifically expressed matriptase (MT-SP1) was inserted into the heavy chain 5C4H-G1T4 or the light chain 5C4L-KTO of the antibody mentioned above to prepare heavy chain variants shown in Table 9 and light chain variants shown in Table 10. These were expressed by a method known to those skilled in the art.

TABLE 9

Heavy chain variants of anti-human PD1 neutralizing antibody

| Heavy chain variant | SEQ ID NO | Protease cleavage sequence insertion position |
|---|---|---|
| 5C4HA12aa-G1T4 | 304 | Between variable region position 113 (Kabat numbering) and constant region position 118 (EU numbering) |
| 5C4HAl2aa-G1T4E | 305 | Between constant region positions 118 and 119 (EU numbering) |

TABLE 10

Light chain variants of anti-human PD1 neutralizing antibody

| Light chain variant | SEQ ID NO | Protease cleavage sequence insertion position |
|---|---|---|
| 5C4LI12aa-KT0 | 306 | Between variable region positions 104 and 105 (Kabat numbering) |
| 5C4LC12aa-KT0 | 307 | Between variable region positions 105 and 106 (Kabat numbering) |
| 5C4LD12aa-KT0 | 308 | Between variable region positions 106 and 107 (Kabat numbering) |
| 5C4LA12aa-KT0 | 309 | Between variable region position 107 (Kabat numbering) and constant region position 108 (EU numbering) (constant region Kabat numbering position 108) |
| 5C4LE12aa-KT0E | 310 | Between constant region positions 108 and 109 (EU numbering) (between constant region Kabat numbering position 108 and constant region Kabat numbering position 109) |
| 5C4LB12aa-KT0B | 311 | Between constant region positions 109 and 110 (EU numbering) (between constant region Kabat numbering position 109 and constant region Kabat numbering position 110) |
| 5C4LB12aa-KT0F | 312 | Between constant region positions 110 and 111 (EU numbering) (between constant region Kabat numbering position 110 and constant region Kabat numbering position 111) |
| 5C4LG12aa-KT0G | 313 | Between constant region positions 111 and 112 (EU numbering) (between constant region Kabat numbering position 111 and constant region Kabat numbering position 112) |
| 5C4LJ12aa-KT0J | 314 | Between constant region positions 112 and 113 (EU numbering) (between constant region Kabat numbering position 112 and constant region Kabat numbering position 113) |
| 5C4LK12aa-KT0K | 315 | Between constant region positions 113 and 114 (EU numbering) (between constant region Kabat numbering position 113 and constant region Kabat numbering position 114) |

IgG1 antibodies (Table 11) harboring the protease cleavage sequence were expressed by transient expression using the heavy chain variants of Table 9 in combination with the light chain 5C4L-KTO or the light chain variants of Table 10 in combination with the heavy chain 5C4H-G1T4 and using Expi293 (Life Technologies Corp.) by method known to those skilled in the art, and purified by a method known to those skilled in the art using protein A. 5C4H-G1T4/5C4L-KTO (heavy chain: SEQ ID NO: 297, light chain: SEQ ID NO: 298) was expressed and purified as a control antibody containing no protease cleavage sequence.

TABLE 11

Antibodies harboring protease cleavage sequence

| Antibody harboring protease cleavage sequence | SEQ ID NO of heavy chain | SEQ ID NO of light chain |
|---|---|---|
| 5C4HA12aa-G1T4/5C4L-KT0 | 304 | 298 |
| 5C4HE12aa-G1T4E/5C4L-KT0 | 305 | 298 |
| 5C4H-G1T4/5C4LI12aa-KT0 | 297 | 306 |
| 5C4H-G1T4/5C4LC12aa-KT0 | 297 | 307 |
| 5C4H-G1T4/5C4LD12aa-KT0 | 297 | 308 |
| 5C4H-G1T4/5C4LA12aa-KT0 | 297 | 309 |
| 5C4H-G1T4/5C4LE12aa-KT0E | 297 | 310 |
| 5C4H-G1T4/5C4LB12aa-KT0B | 297 | 311 |
| 5C4H-G1T4/5C4LF12aa-KT0F | 297 | 312 |
| 5C4H-G1T4/5C4LG12aa-KT0G | 297 | 313 |
| 5C4H-G1T4/5C4LJ12aa-KT0J | 297 | 314 |
| 5C4H-G1T4/5C4LK12aa-KT0K | 297 | 315 |

14-2. Human PD1 Binding Evaluation of Anti-Human PD1 Neutralizing Antibody Harboring Protease Cleavage Sequence 14-2-1 Protease Treatment For protease-treated antibodies, 104 of Recombinant Human Matriptase/ST14 Catalytic Domain (hMT-SP1, R&D Systems, Inc., 3946-SE-010) adjusted to 1.8 µg/mL with PBS was added to each antibody (final concentration: 0.111 mg/mL) prepared in Example 14-1. For protease-untreated antibodies, 10 µL of only PBS was added to each antibody (final concentration: 0.111 mg/mL) prepared in Example 14-1. The sample volume during reaction was 90 µL, and the final concentration of the protease was 0.2 µg/mL. Each sample was incubated at 37° C. for 12 hours.

14-2-2 Preparation of Biotinylated Anti-Human PD1 Neutralizing Antibody

A biotinylated anti-human PD1 neutralizing antibody having the same variable region sequence as that of 5C4H-G1T4/5C4L-KTO was prepared. Specifically, a gene fragment encoding 5C4VH-G1dGSBAP (SEQ ID NO: 317) containing an antibody heavy chain constant region and biotin (AviTag sequence, SEQ ID NO: 316) attached to a heavy chain variable region 5C4H (SEQ ID NO: 300) was prepared and integrated to a vector for expression in animal cells by a method known to those skilled in the art. The constructed expression vector and a vector for the expression of a light chain 5C4L-KTOB (SEQ ID NO: 298) were transfected into FreeStyle 293 cells (Invitrogen Corp.) using 293Fectin (Invitrogen Corp.). In this operation, the cells were cotransfected with a gene for EBNA1 (SEQ ID NO: 318) expression and a gene for biotin ligase (BirA; SEQ ID NO: 319) expression, and biotin was added thereto for the purpose of biotin labeling. The cells thus transfected were cultured at 37° C. under 8% $CO_2$ and caused to secrete the biotinylated anti-human PD1 neutralizing antibody of interest (5C4-bio) into the culture supernatant. 5C4-bio was purified from the culture supernatant by a method known to those skilled in the art.

14-2-3 Human PD1 Binding Evaluation of Each Antibody Before and after Protease Treatment Human PD1 was added at a final concentration of 0.67 µM to 80 µL of each protease-treated antibody or protease-untreated antibody prepared in Example 14-2-1 and bound thereto at room temperature for 30 minutes to prepare samples for binding evaluation. The amount of PD1 unbound with the antibody was evaluated to evaluate the binding of the antibody to PD1 in the presence and absence of protease treatment.

Specifically, the amount of PD1 unbound with the antibody was evaluated by bio-layer interferometry (BLI) using the biotinylated anti-human PD1 neutralizing antibody (5C4-bio) prepared in Example 14-2-2.

The samples for binding evaluation, 5C4-bio, and PBS were dispensed to different wells of Tilted bottom (TW384) Microplates (Pall ForteBio Corp., 18-5076). A streptavidin biosensor (Pall ForteBio Corp., 18-0009) was hydrated using PBS, followed by assay using Octet RED 384 set to 30° C. Baseline measurement was carried out for 30 seconds in the wells containing PBS. Then, 5C4-bio was bound to the streptavidin sensor for 200 seconds. Baseline measurement was carried out again for 30 seconds in the wells containing PBS. Then, binding was measured for 180 seconds in the wells containing the samples for binding evaluation, and dissociation was measured for 180 seconds in the wells containing PBS. Real-time binding graphs showing binding patterns are shown in FIG. 26. As shown in FIG. 26, in the case of the antibodies harboring the protease cleavage sequence, the measured amount of human PD1 bound to 5C4-bio was larger in the samples for binding evaluation containing the protease-treated antibodies than in the samples for binding evaluation containing the protease-untreated antibodies. Thus, the PD1 binding activity of each antibody harboring the protease cleavage sequence was attenuated by protease treatment so that PD1 was released therefrom to bind to 5C4-bio.

14-2-4 Confirmation of Protease Cleavage of Antibody (SDS-PAGE)

Whether the antibodies used in Example 14-2-3 underwent cleavage by protease treatment was confirmed by SDS-PAGE. 10 µL of each protease-cleaved antibody or protease-untreated antibody prepared in Example 14-2-3 was mixed with 3.3 µL of a sample buffer and incubated at 95° C. for 5 minutes. Next, electrophoresis was performed using Mini-PROTEAN TGX gel (4-20% 15 wells) (Bio-Rad Laboratories, Inc., #456-1096), and proteins were stained with Sample Blue Safe Stain (Novex, LC6065). The results are shown in FIG. 27. As shown in FIG. 27, each antibody harboring the protease cleavage sequence was cleaved by protease treatment.

14-2-5 PD1 Binding Evaluation of Antibody Before and after Protease Treatment

The PD1 binding activity of each antibody harboring the protease cleavage sequence before and after protease treatment was also measured by another method.

10 µL of each protease-treated antibody or protease-untreated antibody prepared in Example 14-2-1 was mixed with 70 µL of PBS to prepare PD1 binding assay samples. The PD1 binding of the samples was evaluated by bio-layer interferometry (BLI). The protease-treated antibodies or the protease-untreated antibodies prepared in Example 14-2-1 and human PD1 (250 nM) were dispensed to different wells of Tilted bottom (TW384) Microplates (Pall ForteBio Corp., 18-5076). A protein G sensor (Pall ForteBio Corp., 18-0022) was hydrated using PBS, followed by assay using Octet RED 384 set to 30° C. Baseline measurement was carried out for 30 seconds in the wells containing PBS. Then, the antibodies were bound to the protein G sensor for 200 seconds. Baseline measurement was carried out again for 30 seconds in the wells containing PBS. Then, binding was measured for 180 seconds in the wells containing human PD1, and dissociation was measured for 180 seconds in the wells containing PBS. Real-time binding graphs showing binding patterns are shown in FIG. 28. As shown in FIG. 28, in the case of using each antibody harboring the protease cleavage sequence, the amount of human PD1 bound was decreased for the protease-treated antibody compared with the protease-untreated antibody.

14-3. Protease-Mediated Ligand Release Evaluation of Complex of Ligand (Human PD1) and Anti-Human PD1 Neutralizing Antibody Harboring Protease Cleavage Sequence 14-3-1 Protease Treatment in Presence of Ligand 10 µL of human PD1 adjusted to 6.67 µM with PBS was added to each antibody (final concentration: 0.100 mg/mL) prepared in Example 14-1 to prepare antibody-PD1 complex solutions. For protease-treated samples, 10 µL of Recombinant Human Matriptase/ST14 Catalytic Domain (hMT-SP1, R&D Systems, Inc., 3946-SE-010) adjusted to 5.28 µg/mL with PBS was added to each antibody-PD1 complex solution. For protease-untreated samples, 10 µL of only PBS was added thereto. The final concentration of the protease during reaction was 0.528 µg/mL. Each sample was incubated at 37° C. for 12 hours.

14-3-2 PD1 Release Evaluation after Protease Treatment

The amount of PD1 uncomplexed with the antibody was evaluated by bio-layer interferometry (BLI) using the biotinylated anti-human PD1 neutralizing antibody (5C4-bio) prepared in Example 14-2-2.

Each sample prepared in Example 14-3-1, 5C4-bio, and PBS were dispensed to different wells of Tilted bottom (TW384) Microplates (Pall ForteBio Corp., 18-5076). A streptavidin biosensor (Pall ForteBio Corp., 18-0009) was hydrated using PBS, followed by assay using Octet RED 384 set to 30° C. Baseline measurement was carried out for 30 seconds in the wells containing PBS. Then, 5C4-bio was bound to the streptavidin sensor for 200 seconds. Baseline measurement was carried out again for 30 seconds in the wells containing PBS. Then, binding was measured for 180 seconds in the wells containing the protease-treated samples or the protease-untreated samples, and dissociation was measured for 180 seconds in the wells containing PBS. Real-time binding graphs showing binding patterns are shown in FIG. 29. As shown in FIG. 29, in the case of each antibody harboring the protease cleavage sequence, the amount of human PD1 bound to 5C4-bio was increased in the protease-treated sample compared with the protease-untreated sample. Thus, the PD1 binding activity of each antibody was attenuated by protease treatment so that PD1 was released and released from the antibody-PD1 complex.

Example 15 Preparation and Evaluation of Fusion Protein of Anti-Human PD1 Neutralizing Antibody Harboring Protease Cleavage Sequence and Human PD1 (Anti-PD1 Neutralizing Antibody-PD1 Fusion Protein)

15-1. Preparation of Fusion Protein of Anti-Human PD1 Neutralizing Antibody and Human PD1

A human PD1 sequence (SEQ ID NO: 320) was connected to the N-terminus of the heavy chain or the heavy chain variant of each antibody prepared in Example 14-1 via a flexible linker consisting of a glycine-serine polymer (SEQ ID NO: 321) to prepare PD1-fused heavy chains (Table 12).

TABLE 12

PD1-fused heavy chains

| Heavy chain/ heavy chain variant | Presence or absence of protease cleavage sequence insertion | PD1-fused heavy chain |
|---|---|---|
| 5C4HA12aa-G1T4 (SEQ ID NO: 304) | Present | hPD15C4HA12aa-G1T4 (SEQ ID NO: 323) |
| 5C4HE12aa-G1T4E (Heavy chain SEQ ID NO: 305) | Present | hPD15C4HE12aa-G1T4E (SEQ ID NO: 324) |

Also, a human PD1 sequence (SEQ ID NO: 320) was connected to the N-terminus of the light chain or the light chain variant of each antibody prepared in Example 14-1 via a flexible linker consisting of a glycine-serine polymer (SEQ ID NO: 321) to prepare PD1-fused light chains (Table 13.

TABLE 13

PD1-fused light chains

| Light chain/light chain variant | Presence or absence of protease cleavage sequence insertion | PD1-fused light chain |
|---|---|---|
| 5C4LH12aa-KT0 (SEQ ID NO: 322) | Absent | hPD15C4LH12aa-KT0 (SEQ ID NO: 325) |
| 5C4LI12aa-KT0 (SEQ ID NO: 306) | Present | hPD15C4LI12aa-KT0 (SEQ ID NO: 326) |
| 5C4LC12aa-KT0 (SEQ ID NO: 307) | Present | hPD15C4LC12aa-KT0 (SEQ ID NO: 327) |
| 5C4LD12aa-KT0 (SEQ ID NO: 308) | Present | hPD15C4LD12aa-KT0 (SEQ ID NO: 328) |
| 504LE12aa-KT0E (SEQ ID NO: 310) | Present | hPD15C4LE12aa-KT0E (SEQ ID NO: 329) |
| 5C4LB12aa-KT0B (SEQ ID NO: 311) | Present | hPD15C4LB12aa-KT0B (SEQ ID NO: 330) |
| 5C4LF12aa-KT0F (SEQ ID NO: 312) | Present | hPD15C4LF12aa-KT0F (SEQ ID NO: 331) |
| 5C4L612aa-KT0G (SEQ ID NO: 313) | Present | hPD15C4L612aa-KT0G (SEQ ID NO: 332) |
| 5C4LJ12aa-KT0J (SEQ ID NO: 314) | Present | hPD15C4LJ12aa-KT0J (SEQ ID NO: 333) |
| 5C4LK12aa-KT0K (SEQ ID NO: 315) | Present | hPD15C4LK12aa-KT0K (SEQ ID NO: 334) |

The following anti-PD1 neutralizing antibody-PD1 fusion proteins: hPD15C4HA12aa-G1T4/5C4L-KTO (PD1-fused heavy chain: SEQ ID NO: 323, light chain: SEQ ID NO: 298), hPD15C4HE12aa-G1T4E/5C4L-KTO (PD1-fused heavy chain: SEQ ID NO: 324, light chain: SEQ ID NO: 298), 5C4H-G1T4/hPD15C4LH12aa-KTO (heavy chain: SEQ ID NO: 297, light chain: SEQ ID NO: 325), 5C4H-G1T4/hPD15C4LI12aa-KTO (heavy chain: SEQ ID NO: 297, PD1-fused light chain: SEQ ID NO: 326), 5C4H-G1T4/hPD15C4LC12aa-KTO (heavy chain: SEQ ID NO: 297, PD1-fused light chain: SEQ ID NO: 327), 5C4H-G1T4/hPD15C4LD12aa-KTO (heavy chain: SEQ ID NO: 297, PD1-fused light chain: SEQ ID NO: 328), 5C4H-G1T4/hPD15C4LE12aa-KTOE (heavy chain: SEQ ID NO: 297, PD1-fused light chain: SEQ ID NO: 329), 5C4H-G1T4/hPD15C4LB12aa-KTOB (heavy chain: SEQ ID NO: 297, PD1-fused light chain: SEQ ID NO: 330), 5C4H-G1T4/hPD15C4LF12aa-KTOF (heavy chain: SEQ ID NO: 297, PD1-fused light chain: SEQ ID NO: 331), 5C4H-G1T4/hPD15C4LG12aa-KTOG (heavy chain: SEQ ID NO: 297, PD1-fused light chain: SEQ ID NO: 332), 5C4H-G1T4/hPD15C4LJ 12aa-KTOJ (heavy chain: SEQ ID NO: 297, PD1-fused light chain: SEQ ID NO: 333), and 5C4H-G1T4/hPD15C4LK12aa-KTOK (heavy chain: SEQ ID NO: 297, PD1-fused light chain: SEQ ID NO: 334) in which the PD1-fused heavy chains shown in Table 12 and the light chain 5C4L-KTO are combined or the PD1-fused light chains shown in Table 13 and the heavy chain 5C4H-G1T4 are combined were expressed by transient expression using Expi293 (Life Technologies Corp.) by a method known to those skilled in the art, and purified by a method known to those skilled in the art using protein A. Likewise, 5C4H-G1T4/5C4L-KTO (heavy chain: SEQ ID NO: 297, light chain: SEQ ID NO: 298) was expressed and purified as a control antibody containing no protease cleavage sequence.

15-2. Protease Cleavage Evaluation of Anti-PD1 Neutralizing Antibody-PD1 Fusion Protein 15-2-1 Protease Treatment For protease-treated fusion proteins, 4.94 of Recombinant Human Matriptase/ST14 Catalytic Domain (hMT-SP1, R&D Systems, Inc., 3946-SE-010) adjusted to 16.7 μg/mL with PBS was added to 30 μg of each fusion protein prepared in Example 15-1. For protease-untreated fusion proteins, 4.94 of only PBS was added to 30 μg of each fusion protein prepared in Example 15-1. The protease-treated fusion proteins or the protease-untreated fusion proteins were incubated at 37° C. for 12 hours.

15-2-2 PD1 Release Evaluation by Protease Treatment

PD1 release by protease treatment was evaluated by bio-layer interferometry (BLI) using the biotinylated anti-human PD1 neutralizing antibody (5C4-bio) prepared in Example 14-2-2.

The protease-treated fusion proteins or the protease-untreated fusion proteins prepared in Example 15-2-1, 5C4-bio, and PBS were dispensed to different wells of Tilted bottom (TW384) Microplates (Pall ForteBio Corp., 18-5076). A streptavidin biosensor (Pall ForteBio Corp., 18-0009) was hydrated using PBS, followed by assay using Octet RED 384 set to 30° C. Baseline measurement was carried out for 30 seconds in the wells containing PBS. Then, 5C4-bio was bound to the streptavidin sensor for 200 seconds. Baseline measurement was carried out again for 30 seconds in the wells containing PBS. Then, binding was measured for 180 seconds in the wells containing the protease-treated fusion proteins or the protease-untreated fusion proteins, and dissociation was measured for 180 seconds in the wells containing PBS. Real-time binding graphs showing binding patterns are shown in FIG. 30. As shown in FIG. 30, in the case of each antibody-PD1 fusion protein containing the antibody harboring the protease cleavage sequence, the amount of human PD1 bound to 5C4-bio was increased in the protease-treated sample compared with the protease-untreated sample. Thus, the PD1 binding activity of the antibody in each fusion protein was attenuated by protease treatment so that PD1 was released from the fusion protein.

15-2-3 Confirmation of Cleavage of Anti-PD1 Neutralizing Antibody-PD1 Fusion Protein (SDS-PAGE)

Whether the protease-treated fusion proteins prepared in Example 15-2-1 underwent cleavage by protease treatment was confirmed by SDS-PAGE. 10 μL of each protease-treated fusion protein or protease-untreated fusion protein prepared in Example 15-2-1 was mixed with 3.3 μL of a sample buffer and incubated at 95° C. for 5 minutes. Next, electrophoresis was performed using Mini-PROTEAN TGX gel (4-20% 15 wells) (Bio-Rad Laboratories, Inc., #456-1096), and proteins were stained with Sample Blue Safe Stain (Novex, LC6065). The results are shown in FIG. 31. As shown in FIG. 31, each fusion protein containing the antibody harboring the protease cleavage sequence was cleaved by protease treatment.

The embodiments of the invention mentioned above are described in detail with reference to actual examples and illustrated examples with the aim of helping clear understanding. However, the description and illustration in the

INDUSTRIAL APPLICABILITY

The ligand binding molecule of the present invention in a state with bound with the ligand can be transported in vivo and cleaved in a disease tissue so that its binding to the ligand is attenuated to release the ligand specifically in the disease tissue. Therefore, the disease tissue can be specifically exposed to the ligand. Furthermore, the ligand binding molecule suppresses the biological activity of the ligand during transport and therefore decreases the risk of systemic action of the ligand. Thus, the ligand binding molecule is very useful in the treatment of a disease.

SEQUENCE LISTING (537 sequences)

SEQ ID NO: 1 - protein, 452 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 2 - protein, 216 aa, Artificial Sequence
  an artificially synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3 - protein, 8 aa, Artificial Sequence
  an artificially synthesized sequence
LSGRSDNH

SEQ ID NO: 4 - protein, 460 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSLSGRSDNHASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 5 - protein, 460 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSASLSGRSDNHTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 6 - protein, 460 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVLSGRSDNHSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 7 - protein, 460 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSLSGRSDNHSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 8 - protein, 460 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSALSGRSDNHSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 9 - protein, 460 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSASTLSGRSDNHKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 10 - protein, 460 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSASTKLSGRSDNHGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 11 - protein, 460 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSASLSGRSDNHGKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 12 - protein, 460 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVLSGRSDNHGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 13 - protein, 460 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSLSGRSDNHGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 14 - protein, 460 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSALSGRSDNHGTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 15 - protein, 224 aa, Artificial Sequence
  an artificially synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDIKLSGRSDNHRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16 - protein, 224 aa, Artificial Sequence
  an artificially synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDIKRTLSGRSDNHVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17 - protein, 224 aa, Artificial Sequence
  an artificially synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDLSGRSDNHIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18 - protein, 224 aa, Artificial Sequence
  an artificially synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDILSGRSDNHKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19 - protein, 224 aa, Artificial Sequence
  an artificially synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDIKRLSGRSDNHTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20 - protein, 224 aa, Artificial Sequence
  an artificially synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDIKRTVLSGRSDNHAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21 - protein, 224 aa, Artificial Sequence
  an artificially synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDIKRTVALSGRSDNHAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22 - protein, 224 aa, Artificial Sequence
  an artificially synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDIKRLSGRSDNHGVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 23 - protein, 462 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVGLSGRSDNHGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 24 - protein, 464 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSGLSGRSDNHGSSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 25 - protein, 466 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVGSGLSGRSDNHGSSSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 26 - protein, 468 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVGGSGLSGRSDNHGSSGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 27 - protein, 470 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSGGSGLSGRSDNHGSSGTSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 28 - protein, 10 aa, Artificial Sequence
  an artificially synthesized sequence
GLSGRSDNHG

SEQ ID NO: 29 - protein, 12 aa, Artificial Sequence
  an artificially synthesized sequence
SGLSGRSDNHGS

SEQ ID NO: 30 - protein, 14 aa, Artificial Sequence
  an artificially synthesized sequence
GSGLSGRSDNHGSS

SEQ ID NO: 31 - protein, 16 aa, Artificial Sequence
  an artificially synthesized sequence
GGSGLSGRSDNHGSSG

SEQ ID NO: 32 - protein, 18 aa, Artificial Sequence
  an artificially synthesized sequence
SGGSGLSGRSDNHGSSGT

SEQ ID NO: 33 - protein, 472 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSGGSGLSGRSDNHGSSGTSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 34 - protein, 6 aa, Artificial Sequence
  an artificially synthesized sequence
PLGLAG

SEQ ID NO: 35 - protein, 8 aa, Artificial Sequence
  an artificially synthesized sequence
VPLSLTMG

SEQ ID NO: 36 - protein, 4 aa, Artificial Sequence
  an artificially synthesized sequence
GGGS

SEQ ID NO: 37 - protein, 4 aa, Artificial Sequence
  an artificially synthesized sequence
GGSG

SEQ ID NO: 38 - protein, 4 aa, Artificial Sequence
  an artificially synthesized sequence
GSGG

SEQ ID NO: 39 - protein, 4 aa, Artificial Sequence
  an artificially synthesized sequence
SGGG

SEQ ID NO: 40 - protein, 4 aa, Artificial Sequence
  an artificially synthesized sequence
GSSG

SEQ ID NO: 41 - protein, 5 aa, Artificial Sequence
  an artificially synthesized sequence
GGGGS

SEQ ID NO: 42 - protein, 5 aa, Artificial Sequence
  an artificially synthesized sequence
GGGSG

SEQ ID NO: 43 - protein, 5 aa, Artificial Sequence
  an artificially synthesized sequence
GGSGG

SEQ ID NO: 44 - protein, 5 aa, Artificial Sequence
  an artificially synthesized sequence
GSGGG

SEQ ID NO: 45 - protein, 5 aa, Artificial Sequence
  an artificially synthesized sequence
GSGGS

SEQ ID NO: 46 - protein, 5 aa, Artificial Sequence
  an artificially synthesized sequence
SGGGG

SEQ ID NO: 47 - protein, 5 aa, Artificial Sequence
  an artificially synthesized sequence
GSSGG

SEQ ID NO: 48 - protein, 5 aa, Artificial Sequence
  an artificially synthesized sequence
GSGSG

SEQ ID NO: 49 - protein, 5 aa, Artificial Sequence
  an artificially synthesized sequence
SGGSG

SEQ ID NO: 50 - protein, 5 aa, Artificial Sequence
  an artificially synthesized sequence
GSSSG

SEQ ID NO: 51 - protein, 6 aa, Artificial Sequence
  an artificially synthesized sequence
GGGGGS

SEQ ID NO: 52 - protein, 6 aa, Artificial Sequence
  an artificially synthesized sequence
SGGGGG

SEQ ID NO: 53 - protein, 7 aa, Artificial Sequence
  an artificially synthesized sequence
GGGGGGS

SEQ ID NO: 54 - protein, 7 aa, Artificial Sequence
  an artificially synthesized sequence
SGGGGGG

SEQ ID NO: 55 - protein, 330 aa, Homo sapiens [sequence omitted]

SEQ ID NO: 56 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 57 - protein, 377 aa, Homo sapiens
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 58 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 59 - protein, 462 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSGLSGRSDNHGSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 60 - protein, 468 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSGGSGLSGRSDNHGSSGTSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 61 - protein, 11 aa, Artificial Sequence
  an artificially synthesized sequence
GLSGRSDNHGS

SEQ ID NO: 62 - protein, 20 aa, Artificial Sequence
  an artificially synthesized sequence
TVSSGLSGRSDNHGSSTKGP

SEQ ID NO: 63 - protein, 17 aa, Artificial Sequence
  an artificially synthesized sequence
GGSGLSGRSDNHGSSGT

SEQ ID NO: 64 - protein, 26 aa, Artificial Sequence
  an artificially synthesized sequence
TVSSGGSGLSGRSDNHGSSGTSTKGP

SEQ ID NO: 65 - protein, 454 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 66 - protein, 12 aa, Artificial Sequence
  an artificially synthesized sequence
TSTSGRSANPRG

SEQ ID NO: 67 - protein, 13 aa, Artificial Sequence
  an artificially synthesized sequence
ISSGLLSGRSDNH

SEQ ID NO: 68 - protein, 18 aa, Artificial Sequence
  an artificially synthesized sequence
AVGLLAPPGGLSGRSDNH

SEQ ID NO: 69 - protein, 13 aa, Artificial Sequence
  an artificially synthesized sequence
GAGVPMSMRGGAG

SEQ ID NO: 70 - protein, 13 aa, Artificial Sequence
  an artificially synthesized sequence
GAGIPVSLRSGAG

SEQ ID NO: 71 - protein, 8 aa, Artificial Sequence
  an artificially synthesized sequence
GPLGIAGQ

SEQ ID NO: 72 - protein, 10 aa, Artificial Sequence
  an artificially synthesized sequence
GGPLGMLSQS

SEQ ID NO: 73 - protein, 6 aa, Artificial Sequence
  an artificially synthesized sequence
PLGLWA

SEQ ID NO: 74 - protein, 13 aa, Artificial Sequence
  an artificially synthesized sequence
GAGRPFSMIMGAG

SEQ ID NO: 75 - protein, 13 aa, Artificial Sequence
  an artificially synthesized sequence
GAGVPLSLTMGAG

SEQ ID NO: 76 - protein, 13 aa, Artificial Sequence
  an artificially synthesized sequence
GAGVPLSLYSGAG

SEQ ID NO: 77 - protein, 6 aa, Artificial Sequence
  an artificially synthesized sequence
AANLRN

SEQ ID NO: 78 - protein, 6 aa, Artificial Sequence
  an artificially synthesized sequence
AQAYVK

SEQ ID NO: 79 - protein, 6 aa, Artificial Sequence
  an artificially synthesized sequence
AANYMR

SEQ ID NO: 80 - protein, 6 aa, Artificial Sequence
  an artificially synthesized sequence
AAALTR

SEQ ID NO: 81 - protein, 6 aa, Artificial Sequence
  an artificially synthesized sequence
AQNLMR

SEQ ID NO: 82 - protein, 6 aa, Artificial Sequence
  an artificially synthesized sequence
AANYTK

SEQ ID NO: 83 - protein, 16 aa, Artificial Sequence
  an artificially synthesized sequence
GAGPQGLAGQRGIVAG

SEQ ID NO: 84 - protein, 8 aa, Artificial Sequence
  an artificially synthesized sequence
PRFKIIGG

SEQ ID NO: 85 - protein, 8 aa, Artificial Sequence
  an artificially synthesized sequence
PRFRIIGG

SEQ ID NO: 86 - protein, 9 aa, Artificial Sequence
  an artificially synthesized sequence
GAGSGRSAG

SEQ ID NO: 87 - protein, 5 aa, Artificial Sequence
  an artificially synthesized sequence
SGRSA

SEQ ID NO: 88 - protein, 6 aa, Artificial Sequence
  an artificially synthesized sequence
GSGRSA

SEQ ID NO: 89 - protein, 5 aa, Artificial Sequence
  an artificially synthesized sequence
SGKSA

SEQ ID NO: 90 - protein, 5 aa, Artificial Sequence
  an artificially synthesized sequence
SGRSS

SEQ ID NO: 91 - protein, 5 aa, Artificial Sequence
  an artificially synthesized sequence
SGRRA

SEQ ID NO: 92 - protein, 5 aa, Artificial Sequence
  an artificially synthesized sequence
SGRNA

SEQ ID NO: 93 - protein, 5 aa, Artificial Sequence
  an artificially synthesized sequence
SGRKA

SEQ ID NO: 94 - protein, 6 aa, Artificial Sequence
  an artificially synthesized sequence
QRGRSA

SEQ ID NO: 95 - protein, 17 aa, Artificial Sequence
  an artificially synthesized sequence
GAGSLLKSRMVPNFNAG

SEQ ID NO: 96 - protein, 6 aa, Artificial Sequence
  an artificially synthesized sequence
TQGAAA

SEQ ID NO: 97 - protein, 6 aa, Artificial Sequence
  an artificially synthesized sequence
GAAAAA

SEQ ID NO: 98 - protein, 6 aa, Artificial Sequence
  an artificially synthesized sequence
GAGAAG

SEQ ID NO: 99 - protein, 6 aa, Artificial Sequence
  an artificially synthesized sequence
AAAAAG

SEQ ID NO: 100 - protein, 6 aa, Artificial Sequence
  an artificially synthesized sequence
LCGAAI

SEQ ID NO: 101 - protein, 6 aa, Artificial Sequence
  an artificially synthesized sequence
FAQALG

SEQ ID NO: 102 - protein, 6 aa, Artificial Sequence
  an artificially synthesized sequence
LLQANP

SEQ ID NO: 103 - protein, 6 aa, Artificial Sequence
  an artificially synthesized sequence
LAAANP

SEQ ID NO: 104 - protein, 6 aa, Artificial Sequence
  an artificially synthesized sequence
LYGAQF

SEQ ID NO: 105 - protein, 6 aa, Artificial Sequence
  an artificially synthesized sequence
LSQAQG

SEQ ID NO: 106 - protein, 6 aa, Artificial Sequence
  an artificially synthesized sequence
ASAASG

SEQ ID NO: 107 - protein, 6 aa, Artificial Sequence
  an artificially synthesized sequence
FLGASL

SEQ ID NO: 108 - protein, 6 aa, Artificial Sequence
  an artificially synthesized sequence
AYGATG

SEQ ID NO: 109 - protein, 6 aa, Artificial Sequence
  an artificially synthesized sequence
LAQATG

SEQ ID NO: 110 - protein, 17 aa, Artificial Sequence
  an artificially synthesized sequence
GAGSGVVIATVIVITAG

SEQ ID NO: 111 - protein, 8 aa, Artificial Sequence
  an artificially synthesized sequence
APMAEGGG

SEQ ID NO: 112 - protein, 8 aa, Artificial Sequence
  an artificially synthesized sequence
EAQGDKII

SEQ ID NO: 113 - protein, 8 aa, Artificial Sequence
  an artificially synthesized sequence
LAFSDAGP

SEQ ID NO: 114 - protein, 7 aa, Artificial Sequence
  an artificially synthesized sequence
YVADAPK

SEQ ID NO: 115 - protein, 5 aa, Artificial Sequence
  an artificially synthesized sequence
RRRRR

SEQ ID NO: 116 - protein, 6 aa, Artificial Sequence
  an artificially synthesized sequence
RRRRRR

SEQ ID NO: 117 - protein, 10 aa, Artificial Sequence
  an artificially synthesized sequence
GQSSRHRRAL

SEQ ID NO: 118 - protein, 9 aa, Artificial Sequence
  an artificially synthesized sequence
SSRHRRALD

SEQ ID NO: 119 - protein, 14 aa, Artificial Sequence
  an artificially synthesized sequence
RKSSIIIRMRDVVL

SEQ ID NO: 120 - protein, 15 aa, Artificial Sequence
  an artificially synthesized sequence
SSSFDKGKYKKGDDA

SEQ ID NO: 121 - protein, 15 aa, Artificial Sequence
  an artificially synthesized sequence
SSSFDKGKYKRGDDA

SEQ ID NO: 122 - protein, 4 aa, Artificial Sequence
  an artificially synthesized sequence
IEGR

SEQ ID NO: 123 - protein, 4 aa, Artificial Sequence
  an artificially synthesized sequence
IDGR

SEQ ID NO: 124 - protein, 7 aa, Artificial Sequence
  an artificially synthesized sequence
GGSIDGR

SEQ ID NO: 125 - protein, 8 aa, Artificial Sequence
  an artificially synthesized sequence
GPQGIAGQ

SEQ ID NO: 126 - protein, 8 aa, Artificial Sequence
  an artificially synthesized sequence
GPQGLLGA

SEQ ID NO: 127 - protein, 5 aa, Artificial Sequence
  an artificially synthesized sequence
GIAGQ

SEQ ID NO: 128 - protein, 7 aa, Artificial Sequence
  an artificially synthesized sequence
GPLGIAG

SEQ ID NO: 129 - protein, 8 aa, Artificial Sequence
  an artificially synthesized sequence
GPEGLRVG

SEQ ID NO: 130 - protein, 8 aa, Artificial Sequence
  an artificially synthesized sequence
YGAGLGVV

SEQ ID NO: 131 - protein, 8 aa, Artificial Sequence
  an artificially synthesized sequence
AGLGVVER

SEQ ID NO: 132 - protein, 8 aa, Artificial Sequence
  an artificially synthesized sequence
AGLGISST

SEQ ID NO: 133 - protein, 8 aa, Artificial Sequence
  an artificially synthesized sequence
EPQALAMS

SEQ ID NO: 134 - protein, 8 aa, Artificial Sequence
  an artificially synthesized sequence
QALAMSAI

SEQ ID NO: 135 - protein, 8 aa, Artificial Sequence
  an artificially synthesized sequence
AAYHLVSQ

SEQ ID NO: 136 - protein, 8 aa, Artificial Sequence
  an artificially synthesized sequence
MDAFLESS

SEQ ID NO: 137 - protein, 8 aa, Artificial Sequence
  an artificially synthesized sequence
ESLPVVAV

SEQ ID NO: 138 - protein, 8 aa, Artificial Sequence
  an artificially synthesized sequence
SAPAVESE

SEQ ID NO: 139 - protein, 8 aa, Artificial Sequence
  an artificially synthesized sequence
DVAQFVLT

SEQ ID NO: 140 - protein, 8 aa, Artificial Sequence
  an artificially synthesized sequence
VAQFVLTE

SEQ ID NO: 141 - protein, 8 aa, Artificial Sequence
  an artificially synthesized sequence
AQFVLTEG

SEQ ID NO: 142 - protein, 8 aa, Artificial Sequence
  an artificially synthesized sequence
PVQPIGPQ

SEQ ID NO: 143 - protein, 6 aa, Artificial Sequence
  an artificially synthesized sequence
LVPRGS

SEQ ID NO: 144 - protein, 447 aa, Artificial Sequence
  an artificially synthesized sequence
EVQLVQSGAEVKKPGESLKISCKGSGYSFTTYWLGWVRQMPGKGLDWIGIMSPVDSDIRYSPSFQGQVTMSVDKSITTAYLQWNSLKASDTAMYYCARRRPGQGYFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 145 - protein, 214 aa, Artificial Sequence
  an artificially synthesized sequence
DIQMTQSPSSLSASVGDRVTITCRASQGISSWLAWYQQKPEKAPKSLIYAASSLQSGVPSRFSGSGSGTDFTLTISSLQPEDFATYYCQQYNIYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 146 - protein, 461 aa, Artificial Sequence
  an artificially synthesized sequence
EVQLVQSGAEVKKPGESLKISCKGSGYSFTTYWLGWVRQMPGKGLDWIGIMSPVDSDIRYSPSFQGQVTMSVDKSITTAYLQWNSLKASDTAMYYCARRRPGQGYFDFWGQGTLVTVSSASGSGLSGRSDNHGSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 147 - protein, 447 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 148 - protein, 214 aa, Artificial Sequence [sequence omitted]

SEQ ID NO: 149 - protein, 16 aa, Artificial Sequence
  an artificially synthesized sequence
GGGGSPLGLAGGGGGS

SEQ ID NO: 150 - protein, 18 aa, Artificial Sequence
  an artificially synthesized sequence
GGGGSGPLGIAGQGGGGS

SEQ ID NO: 151 - protein, 16 aa, Artificial Sequence
  an artificially synthesized sequence
GGGGSPLGLWAGGGGS

SEQ ID NO: 152 - protein, 23 aa, Artificial Sequence
  an artificially synthesized sequence
GGGGSGAGVPLSLYSGAGGGGGS

SEQ ID NO: 153 - protein, 463 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGGGSPLGLAGGGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 154 - protein, 465 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGGGSGPLGIAGQGGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 155 - protein, 463 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGGGSPLGLWAGGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 156 - protein, 470 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGGGSGAGVPLSLYSGAGGGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 157 - protein, 460 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGAGIPVSLRSGAGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 158 - protein, 457 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGPLGMLSQSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 159 - protein, 460 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGAGVPLSLTMGAGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 160 - protein, 12 aa, Artificial Sequence
  an artificially synthesized sequence
TSTSGRSANPRG

SEQ ID NO: 161 - protein, 119 aa, Artificial Sequence [sequence omitted]

SEQ ID NO: 162 - protein, 328 aa, Artificial Sequence
  an artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 163 - protein, 131 aa, Artificial Sequence
  an artificially synthesized sequence
QVQLQESTSTSGRSANPRGGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 164 - protein, 131 aa, Artificial Sequence
  an artificially synthesized sequence
QVQLQESGTSTSGRSANPRGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 165 - protein, 131 aa, Artificial Sequence
  an artificially synthesized sequence
QVQLQESGPTSTSGRSANPRGGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 166 - protein, 131 aa, Artificial Sequence
  an artificially synthesized sequence
QVQLQESGPGTSTSGRSANPRGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 167 - protein, 131 aa, Artificial Sequence
  an artificially synthesized sequence
QVQLQESGPGLTSTSGRSANPRGVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 168 - protein, 131 aa, Artificial Sequence
  an artificially synthesized sequence
QVQLQESGPGLVTSTSGRSANPRGRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 169 - protein, 131 aa, Artificial Sequence
  an artificially synthesized sequence
QVQLQESGPGLVRTSTSGRSANPRGPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 170 - protein, 131 aa, Artificial Sequence
  an artificially synthesized sequence
QVQLQESGPGLVRPTSTSGRSANPRGSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 171 - protein, 131 aa, Artificial Sequence
  an artificially synthesized sequence
QVQLQESGPGLVRPSTSTSGRSANPRGQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 172 - protein, 131 aa, Artificial Sequence
  an artificially synthesized sequence
QVQLQESGPGLVRPSQTLSLTCTVSGYSITSDHAWSWVRQPTSTSGRSANPRGPGRGLEWIGYISYSGITTYNPSLKSRVTMLRDTSKNQFSLRLSSVTAADTAVYYCARSLARTTAMDYWGQGSLVTVSS

SEQ ID NO: 173 - protein, 131 aa, Artificial Sequence
  an artificially synthesized sequence
QVQLQESGPGLVRPSQTLSLTCTVSGYSITSDHAWSWVRQPPTSTSGRSANPRGGRGLEWIGYISYSGITTYNPSLKSRVTMLRDTSKNQFSLRLSSVTAADTAVYYCARSLARTTAMDYWGQGSLVTVSS

SEQ ID NO: 174 - protein, 131 aa, Artificial Sequence
  an artificially synthesized sequence
QVQLQESGPGLVRPSQTLSLTCTVSGYSITSDHAWSWVRQPPGTSTSGRSANPRGRGLEWIGYISYSGITTYNPSLKSRVTMLRDTSKNQFSLRLSSVTAADTAVYYCARSLARTTAMDYWGQGSLVTVSS

SEQ ID NO: 175 - protein, 131 aa, Artificial Sequence
  an artificially synthesized sequence
QVQLQESGPGLVRPSQTLSLTCTVSGYSITSDHAWSWVRQPPGRTSTSGRSANPRGGLEWIGYISYSGITTYNPSLKSRVTMLRDTSKNQFSLRLSSVTAADTAVYYCARSLARTTAMDYWGQGSLVTVSS

SEQ ID NO: 176 - protein, 131 aa, Artificial Sequence
  an artificially synthesized sequence
QVQLQESGPGLVRPSQTLSLTCTVSGYSITSDHAWSWVRQPPGRGTSTSGRSANPRGLEWIGYISYSGITTYNPSLKSRVTMLRDTSKNQFSLRLSSVTAADTAVYYCARSLARTTAMDYWGQGSLVTVSS

SEQ ID NO: 177 - protein, 131 aa, Artificial Sequence
  an artificially synthesized sequence
QVQLQESGPGLVRPSQTLSLTCTVSGYSITSDHAWSWVRQPPGRGLTSTSGRSANPRGEWIGYISYSGITTYNPSLKSRVTMLRDTSKNQFSLRLSSVTAADTAVYYCARSLARTTAMDYWGQGSLVTVSS

SEQ ID NO: 178 - protein, 131 aa, Artificial Sequence
  an artificially synthesized sequence
QVQLQESGPGLVRPSQTLSLTCTVSGYSITSDHAWSWVRQPPGRGLEWIGYISYSGTSTSGRSANPRGITTYNPSLKSRVTMLRDTSKNQFSLRLSSVTAADTAVYYCARSLARTTAMDYWGQGSLVTVSS

SEQ ID NO: 179 - protein, 131 aa, Artificial Sequence
  an artificially synthesized sequence
QVQLQESGPGLVRPSQTLSLTCTVSGYSITSDHAWSWVRQPPGRGLEWIGYISYSGITSTSGRSANPRGTTYNPSLKSRVTMLRDTSKNQFSLRLSSVTAADTAVYYCARSLARTTAMDYWGQGSLVTVSS

SEQ ID NO: 180 - protein, 131 aa, Artificial Sequence
  an artificially synthesized sequence
QVQLQESGPGLVRPSQTLSLTCTVSGYSITSDHAWSWVRQPPGRGLEWIGYISYSGITTSTSGRSANPRGTYNPSLKSRVTMLRDTSKNQFSLRLSSVTAADTAVYYCARSLARTTAMDYWGQGSLVTVSS

SEQ ID NO: 181 - protein, 131 aa, Artificial Sequence
  an artificially synthesized sequence
QVQLQESGPGLVRPSQTLSLTCTVSGYSITSDHAWSWVRQPPGRGLEWIGYISYSGITTTSTSGRSANPRGYNPSLKSRVTMLRDTSKNQFSLRLSSVTAADTAVYYCARSLARTTAMDYWGQGSLVTVSS

SEQ ID NO: 182 - protein, 131 aa, Artificial Sequence
  an artificially synthesized sequence
QVQLQESGPGLVRPSQTLSLTCTVSGYSITSDHAWSWVRQPPGRGLEWIGYISYSGITTYTSTSGRSANPRGNPSLKSRVTMLRDTSKNQFSLRLSSVTAADTAVYYCARSLARTTAMDYWGQGSLVTVSS

SEQ ID NO: 183 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNTSTSGRSANPRGPSLKSRVTMLRDTSKNQFSLRLSSVTAADTAVYYCARSLARTTAMDYWGQGSLVTVSS

SEQ ID NO: 184 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPTSTSGRSANPRGSLKSRVTMLRDTSKNQFSLRLSSVTAADTAVYYCARSLARTTAMDYWGQGSLVTVSS

SEQ ID NO: 185 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSTSTSGRSANPRGLKSRVTMLRDTSKNQFSLRLSSVTAADTAVYYCARSLARTTAMDYWGQGSLVTVSS

SEQ ID NO: 186 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLTSTSGRSANPRGKSRVTMLRDTSKNQFSLRLSSVTAADTAVYYCARSLARTTAMDYWGQGSLVTVSS

SEQ ID NO: 187 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKTSTSGRSANPRGSRVTMLRDTSKNQFSLRLSSVTAADTAVYYCARSLARTTAMDYWGQGSLVTVSS

SEQ ID NO: 188 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSTSTSGRSANPRGRVTMLRDTSKNQFSLRLSSVTAADTAVYYCARSLARTTAMDYWGQGSLVTVSS

SEQ ID NO: 189 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRTSTSGRSANPRGVTMLRDTSKNQFSLRLSSVTAADTAVYYCARSLARTTAMDYWGQGSLVTVSS

SEQ ID NO: 190 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTSTSGRSANPRGTMLRDTSKNQFSLRLSSVTAADTAVYYCARSLARTTAMDYWGQGSLVTVSS

SEQ ID NO: 191 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTTSTSGRSANPRGMLRDTSKNQFSLRLSSVTAADTAVYYCARSLARTTAMDYWGQGSLVTVSS

SEQ ID NO: 192 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTTSTSGRSANPRGSKNQFSLRLSSVTAADTAVYYCARSLARTTAMDYWGQGSLVTVSS

SEQ ID NO: 193 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSTSTSGRSANPRGKNQFSLRLSSVTAADTAVYYCARSLARTTAMDYWGQGSLVTVSS

SEQ ID NO: 194 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKTSTSGRSANPRGNQFSLRLSSVTAADTAVYYCARSLARTTAMDYWGQGSLVTVSS

SEQ ID NO: 195 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNTSTSGRSANPRGQFSLRLSSVTAADTAVYYCARSLARTTAMDYWGQGSLVTVSS

SEQ ID NO: 196 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQTSTSGRSANPRGFSLRLSSVTAADTAVYYCARSLARTTAMDYWGQGSLVTVSS

SEQ ID NO: 197 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTTSTSGRSANPRGAADTAVYYCARSLARTTAMDYWGQGSLVTVSS

SEQ ID NO: 198 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTATSTSGRSANPRGADTAVYYCARSLARTTAMDYWGQGSLVTVSS

SEQ ID NO: 199 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAATSTSGRSANPRGDTAVYYCARSLARTTAMDYWGQGSLVTVSS

SEQ ID NO: 200 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSTSTSGRSANPRGLARTTAMDYWGQGSLVTVSS

SEQ ID NO: 201 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLTSTSGRSANPRGARTTAMDYWGQGSLVTVSS

SEQ ID NO: 202 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLATSTSGRSANPRGRTTAMDYWGQGSLVTVSS

SEQ ID NO: 203 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTSTSGRSANPRGTTAMDYWGQGSLVTVSS

SEQ ID NO: 204 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWTSTSGRSANPRGGQGSLVTVSS

SEQ ID NO: 205 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGTSTSGRSANPRGQGSLVTVSS

SEQ ID NO: 206 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQTSTSGRSANPRGGSLVTVSS

SEQ ID NO: 207 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGTSTSGRSANPRGSLVTVSS

SEQ ID NO: 208 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSTSTSGRSANPRGLVTVSS

SEQ ID NO: 209 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLTSTSGRSANPRGVTVSS

SEQ ID NO: 210 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTSTSGRSANPRGTVSS

SEQ ID NO: 211 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTTSTSGRSANPRGVSS

SEQ ID NO: 212 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVTSTSGRSANPRGSS

SEQ ID NO: 213 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSTSTSGRSANPRGS

SEQ ID NO: 214 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSTSTSGRSANPRG

SEQ ID NO: 215 - protein, 340 aa, Artificial Sequence
  an artificially synthesized sequence
ATSTSGRSANPRGSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 216 - protein, 340 aa, Artificial Sequence
  an artificially synthesized sequence
ASTSTSGRSANPRGTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 217 - protein, 340 aa, Artificial Sequence
  an artificially synthesized sequence
ASTTSTSGRSANPRGKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 218 - protein, 340 aa, Artificial Sequence
  an artificially synthesized sequence
ASTKTSTSGRSANPRGGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 219 - protein, 340 aa, Artificial Sequence
  an artificially synthesized sequence
ASTKGTSTSGRSANPRGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 220 - protein, 340 aa, Artificial Sequence
  an artificially synthesized sequence
ASTKGPTSTSGRSANPRGSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 221 - protein, 340 aa, Artificial Sequence
  an artificially synthesized sequence
ASTKGPSTSTSGRSANPRGVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 222 - protein, 340 aa, Artificial Sequence
  an artificially synthesized sequence
ASTKGPSVFPLATSTSGRSANPRGPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 223 - protein, 340 aa, Artificial Sequence
  an artificially synthesized sequence
ASTKGPSVFPLAPTSTSGRSANPRGSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 224 - protein, 340 aa, Artificial Sequence
  an artificially synthesized sequence
ASTKGPSVFPLAPSTSTSGRSANPRGSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 225 - protein, 340 aa, Artificial Sequence
  an artificially synthesized sequence
ASTKGPSVFPLAPSSTSTSGRSANPRGKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 226 - protein, 340 aa, Artificial Sequence
  an artificially synthesized sequence
ASTKGPSVFPLAPSSKSTSTSGRSANPRGTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 227 - protein, 340 aa, Artificial Sequence
  an artificially synthesized sequence
ASTKGPSVFPLAPSSKSTTSTSGRSANPRGSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 228 - protein, 340 aa, Artificial Sequence
  an artificially synthesized sequence
ASTKGPSVFPLAPSSKSTSGTSTSGRSANPRGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 229 - protein, 340 aa, Artificial Sequence
  an artificially synthesized sequence
ASTKGPSVFPLAPSSKSTSGGTTSTSGRSANPRGAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 230 - protein, 107 aa, Artificial Sequence [sequence omitted]

SEQ ID NO: 231 - protein, 107 aa, Artificial Sequence [sequence omitted]

SEQ ID NO: 232 - protein, 119 aa, Artificial Sequence
  an artificially synthesized sequence
DIQMTQSTSTSGRSANPRGPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 233 - protein, 119 aa, Artificial Sequence
  an artificially synthesized sequence
DIQMTQSPTSTSGRSANPRGSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 234 - protein, 119 aa, Artificial Sequence
  an artificially synthesized sequence
DIQMTQSPSTSTSGRSANPRGSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 235 - protein, 119 aa, Artificial Sequence
  an artificially synthesized sequence
DIQMTQSPSSTSTSGRSANPRGLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 236 - protein, 119 aa, Artificial Sequence
  an artificially synthesized sequence
DIQMTQSPSSLTSTSGRSANPRGSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 237 - protein, 119 aa, Artificial Sequence
  an artificially synthesized sequence
DIQMTQSPSSLSTSTSGRSANPRGASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 238 - protein, 119 aa, Artificial Sequence
  an artificially synthesized sequence
DIQMTQSPSSLSATSTSGRSANPRGSVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 239 - protein, 119 aa, Artificial Sequence
  an artificially synthesized sequence
DIQMTQSPSSLSASTSTSGRSANPRGVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 240 - protein, 119 aa, Artificial Sequence
  an artificially synthesized sequence
DIQMTQSPSSLSASVTSTSGRSANPRGGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 241 - protein, 119 aa, Artificial Sequence
  an artificially synthesized sequence
DIQMTQSPSSLSASVGTSTSGRSANPRGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 242 - protein, 119 aa, Artificial Sequence
  an artificially synthesized sequence
DIQMTQSPSSLSASVGDTSTSGRSANPRGRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 243 - protein, 119 aa, Artificial Sequence
  an artificially synthesized sequence
DIQMTQSPSSLSASVGDRTSTSGRSANPRGVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 244 - protein, 119 aa, Artificial Sequence
  an artificially synthesized sequence
DIQMTQSPSSLSASVGDRVTITCRASQDISSYLNWYQQKTSTSGRSANPRGPGKAPKLLIYYTSRLHSGVPSRFSGSGSGTDFTFTISSLQPEDIATYYCQQGNTLPYTFGQGTKVEIK

SEQ ID NO: 245 - protein, 119 aa, Artificial Sequence
  an artificially synthesized sequence
DIQMTQSPSSLSASVGDRVTITCRASQDISSYLNWYQQKPTSTSGRSANPRGGKAPKLLIYYTSRLHSGVPSRFSGSGSGTDFTFTISSLQPEDIATYYCQQGNTLPYTFGQGTKVEIK

SEQ ID NO: 246 - protein, 119 aa, Artificial Sequence
  an artificially synthesized sequence
DIQMTQSPSSLSASVGDRVTITCRASQDISSYLNWYQQKPGTSTSGRSANPRGKAPKLLIYYTSRLHSGVPSRFSGSGSGTDFTFTISSLQPEDIATYYCQQGNTLPYTFGQGTKVEIK

SEQ ID NO: 247 - protein, 119 aa, Artificial Sequence
  an artificially synthesized sequence
DIQMTQSPSSLSASVGDRVTITCRASQDISSYLNWYQQKPGKTSTSGRSANPRGAPKLLIYYTSRLHSGVPSRFSGSGSGTDFTFTISSLQPEDIATYYCQQGNTLPYTFGQGTKVEIK

SEQ ID NO: 248 - protein, 119 aa, Artificial Sequence
  an artificially synthesized sequence
DIQMTQSPSSLSASVGDRVTITCRASQDISSYLNWYQQKPGKATSTSGRSANPRGPKLLIYYTSRLHSGVPSRFSGSGSGTDFTFTISSLQPEDIATYYCQQGNTLPYTFGQGTKVEIK

SEQ ID NO: 249 - protein, 119 aa, Artificial Sequence
  an artificially synthesized sequence
DIQMTQSPSSLSASVGDRVTITCRASQDISSYLNWYQQKPGKAPTSTSGRSANPRGKLLIYYTSRLHSGVPSRFSGSGSGTDFTFTISSLQPEDIATYYCQQGNTLPYTFGQGTKVEIK

SEQ ID NO: 250 - protein, 119 aa, Artificial Sequence
  an artificially synthesized sequence
DIQMTQSPSSLSASVGDRVTITCRASQDISSYLNWYQQKPGKAPKTSTSGRSANPRGLLIYYTSRLHSGVPSRFSGSGSGTDFTFTISSLQPEDIATYYCQQGNTLPYTFGQGTKVEIK

SEQ ID NO: 251 - protein, 119 aa, Artificial Sequence
  an artificially synthesized sequence
DIQMTQSPSSLSASVGDRVTITCRASQDISSYLNWYQQKPGKAPKLLIYTSTSGRSANPRGYTSRLHSGVPSRFSGSGSGTDFTFTISSLQPEDIATYYCQQGNTLPYTFGQGTKVEIK

SEQ ID NO: 252 - protein, 119 aa, Artificial Sequence
  an artificially synthesized sequence
DIQMTQSPSSLSASVGDRVTITCRASQDISSYLNWYQQKPGKAPKLLIYYTSTSGRSANPRGTSRLHSGVPSRFSGSGSGTDFTFTISSLQPEDIATYYCQQGNTLPYTFGQGTKVEIK

SEQ ID NO: 253 - protein, 119 aa, Artificial Sequence
  an artificially synthesized sequence
DIQMTQSPSSLSASVGDRVTITCRASQDISSYLNWYQQKPGKAPKLLIYYTTSTSGRSANPRGSRLHSGVPSRFSGSGSGTDFTFTISSLQPEDIATYYCQQGNTLPYTFGQGTKVEIK

SEQ ID NO: 254 - protein, 119 aa, Artificial Sequence
  an artificially synthesized sequence
DIQMTQSPSSLSASVGDRVTITCRASQDISSYLNWYQQKPGKAPKLLIYYTSTSTSGRSANPRGRLHSGVPSRFSGSGSGTDFTFTISSLQPEDIATYYCQQGNTLPYTFGQGTKVEIK

SEQ ID NO: 255 - protein, 119 aa, Artificial Sequence
  an artificially synthesized sequence
DIQMTQSPSSLSASVGDRVTITCRASQDISSYLNWYQQKPGKAPKLLIYYTSRTSTSGRSANPRGLHSGVPSRFSGSGSGTDFTFTISSLQPEDIATYYCQQGNTLPYTFGQGTKVEIK

SEQ ID NO: 256 - protein, 119 aa, Artificial Sequence
  an artificially synthesized sequence
DIQMTQSPSSLSASVGDRVTITCRASQDISSYLNWYQQKPGKAPKLLIYYTSRLTSTSGRSANPRGHSGVPSRFSGSGSGTDFTFTISSLQPEDIATYYCQQGNTLPYTFGQGTKVEIK

SEQ ID NO: 257 - protein, 119 aa, Artificial Sequence
  an artificially synthesized sequence
DIQMTQSPSSLSASVGDRVTITCRASQDISSYLNWYQQKPGKAPKLLIYYTSRLHTSTSGRSANPRGSGVPSRFSGSGSGTDFTFTISSLQPEDIATYYCQQGNTLPYTFGQGTKVEIK

SEQ ID NO: 258 - protein, 119 aa, Artificial Sequence
  an artificially synthesized sequence
DIQMTQSPSSLSASVGDRVTITCRASQDISSYLNWYQQKPGKAPKLLIYYTSRLHSTSTSGRSANPRGGVPSRFSGSGSGTDFTFTISSLQPEDIATYYCQQGNTLPYTFGQGTKVEIK

SEQ ID NO: 259 - protein, 119 aa, Artificial Sequence
  an artificially synthesized sequence
DIQMTQSPSSLSASVGDRVTITCRASQDISSYLNWYQQKPGKAPKLLIYYTSRLHSGTSTSGRSANPRGVPSRFSGSGSGTDFTFTISSLQPEDIATYYCQQGNTLPYTFGQGTKVEIK

SEQ ID NO: 260 - protein, 119 aa, Artificial Sequence
  an artificially synthesized sequence
DIQMTQSPSSLSASVGDRVTITCRASQDISSYLNWYQQKPGKAPKLLIYYTSRLHSGVTSTSGRSANPRGPSRFSGSGSGTDFTFTISSLQPEDIATYYCQQGNTLPYTFGQGTKVEIK

SEQ ID NO: 261 - protein, 119 aa, Artificial Sequence
  an artificially synthesized sequence
DIQMTQSPSSLSASVGDRVTITCRASQDISSYLNWYQQKPGKAPKLLIYYTSRLHSGVPTSTSGRSANPRGSRFSGSGSGTDFTFTISSLQPEDIATYYCQQGNTLPYTFGQGTKVEIK

SEQ ID NO: 262 - protein, 119 aa, Artificial Sequence
  an artificially synthesized sequence
DIQMTQSPSSLSASVGDRVTITCRASQDISSYLNWYQQKPGKAPKLLIYYTSRLHSGVPSTSTSGRSANPRGRFSGSGSGTDFTFTISSLQPEDIATYYCQQGNTLPYTFGQGTKVEIK

SEQ ID NO: 263 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTSTSGRSANPRGTFGQGTKVEIK

SEQ ID NO: 264 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTTSTSGRSANPRGFGQGTKVEIK

SEQ ID NO: 265 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFTSTSGRSANPRGGQGTKVEIK

SEQ ID NO: 266 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGTSTSGRSANPRGQGTKVEIK

SEQ ID NO: 267 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQTSTSGRSANPRGGTKVEIK

SEQ ID NO: 268 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTSTSGRSANPRGTKVEIK

SEQ ID NO: 269 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTTSTSGRSANPRGKVEIK

SEQ ID NO: 270 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKTSTSGRSANPRGVEIK

SEQ ID NO: 271 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVTSTSGRSANPRGEIK

SEQ ID NO: 272 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVETSTSGRSANPRGIK

SEQ ID NO: 273 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEITSTSGRSANPRGK

SEQ ID NO: 274 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKTSTSGRSANPRG

SEQ ID NO: 275 - protein, 119 aa, Artificial Sequence
  an artificially synthesized sequence
RTSTSGRSANPRGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 276 - protein, 119 aa, Artificial Sequence
  an artificially synthesized sequence
RTTSTSGRSANPRGVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 277 - protein, 119 aa, Artificial Sequence
  an artificially synthesized sequence
RTVTSTSGRSANPRGAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 278 - protein, 119 aa, Artificial Sequence
  an artificially synthesized sequence
RTVATSTSGRSANPRGAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 279 - protein, 119 aa, Artificial Sequence
  an artificially synthesized sequence
RTVAATSTSGRSANPRGPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 280 - protein, 119 aa, Artificial Sequence
  an artificially synthesized sequence
RTVAAPTSTSGRSANPRGSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 281 - protein, 119 aa, Artificial Sequence
  an artificially synthesized sequence
RTVAAPSVTSTSGRSANPRGFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 282 - protein, 119 aa, Artificial Sequence
  an artificially synthesized sequence
RTVAAPSVFTSTSGRSANPRGIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 283 - protein, 119 aa, Artificial Sequence
  an artificially synthesized sequence
RTVAAPSVFITSTSGRSANPRGFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 284 - protein, 119 aa, Artificial Sequence
  an artificially synthesized sequence
RTVAAPSVFIFTSTSGRSANPRGPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 285 - protein, 119 aa, Artificial Sequence
  an artificially synthesized sequence
RTVAAPSVFIFPTSTSGRSANPRGPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 286 - protein, 119 aa, Artificial Sequence
  an artificially synthesized sequence
RTVAAPSVFIFPPTSTSGRSANPRGSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 287 - protein, 119 aa, Artificial Sequence
  an artificially synthesized sequence
RTVAAPSVFIFPPSTSTSGRSANPRGDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 288 - protein, 119 aa, Artificial Sequence
  an artificially synthesized sequence
RTVAAPSVFIFPPSDTSTSGRSANPRGEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 289 - protein, 119 aa, Artificial Sequence
  an artificially synthesized sequence
RTVAAPSVFIFPPSDETSTSGRSANPRGQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 290 - protein, 119 aa, Artificial Sequence
  an artificially synthesized sequence
RTVAAPSVFIFPPSDEQTSTSGRSANPRGLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 291 - protein, 119 aa, Artificial Sequence
  an artificially synthesized sequence
RTVAAPSVFIFPPSDEQLTSTSGRSANPRGKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 292 - protein, 119 aa, Artificial Sequence
  an artificially synthesized sequence
RTVAAPSVFIFPPSDEQLKTSTSGRSANPRGSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 293 - protein, 119 aa, Artificial Sequence
  an artificially synthesized sequence
RTVAAPSVFIFPPSDEQLKSTSTSGRSANPRGGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 294 - protein, 119 aa, Artificial Sequence
  an artificially synthesized sequence
RTVAAPSVFIFPPSDEQLKSGTSTSGRSANPRGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 295 - protein, 119 aa, Artificial Sequence
  an artificially synthesized sequence
RTVAAPSVFIFPPSDEQLKSGTTSTSGRSANPRGASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 296 - protein, 119 aa, Artificial Sequence
  an artificially synthesized sequence
RTVAAPSVFIFPPSDEQLKSGTATSTSGRSANPRGSVVCLLNNFYPREAKVQWKVDNALQSGNSQESVTEQDSKDSTYSLSSTLTLSKADYEKHKVYACEVTHQGLSSPVTKSFNRGEC

SEQ ID NO: 297 - protein, 441 aa, Artificial Sequence
  an artificially synthesized sequence
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 298 - protein, 214 aa, Artificial Sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 299 - protein, 12 aa, Artificial Sequence
  an artificially synthesized sequence
TSTSGRSANPRG

SEQ ID NO: 300 - protein, 113 aa, Artificial Sequence [sequence omitted]

SEQ ID NO: 301 - protein, 328 aa, Artificial Sequence; identical to SEQ ID NO: 162
  an artificially synthesized sequence

SEQ ID NO: 302 - protein, 107 aa, Artificial Sequence [sequence omitted]

SEQ ID NO: 303 - protein, 107 aa, Artificial Sequence [sequence omitted]

SEQ ID NO: 304 - protein, 453 aa, Artificial Sequence
  an artificially synthesized sequence
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSTSTSGRSANPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 305 - protein, 453 aa, Artificial Sequence
  an artificially synthesized sequence
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSATSTSGRSANPRGSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 306 - protein, 226 aa, Artificial Sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVTSTSGRSANPRGEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 307 - protein, 226 aa, Artificial Sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVETSTSGRSANPRGIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 308 - protein, 226 aa, Artificial Sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEITSTSGRSANPRGKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 309 - protein, 226 aa, Artificial Sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKTSTSGRSANPRGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 310 - protein, 226 aa, Artificial Sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTSTSGRSANPRGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 311 - protein, 226 aa, Artificial Sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTTSTSGRSANPRGVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 312 - protein, 226 aa, Artificial Sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVTSTSGRSANPRGAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 313 - protein, 226 aa, Artificial Sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVATSTSGRSANPRGAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 314 - protein, 226 aa, Artificial Sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAATSTSGRSANPRGPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 315 - protein, 226 aa, Artificial Sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPTSTSGRSANPRGSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 316 - protein, 15 aa, Artificial Sequence
  an artificially synthesized sequence
GLNDIFEAQKIEWHE

SEQ ID NO: 317 - protein, 461 aa, Artificial Sequence
  an artificially synthesized sequence
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGLNDIFEAQKIEWHE

SEQ ID NO: 318 - protein, 641 aa, Artificial Sequence
  an artificially synthesized sequence
MSDEGPGTGPGNGLGEKGDTSGPEGSGGSGPQRRGGDNHGRGRGRGRGRGGGRPGAPGGSGSGPRHRDGVRRPQKRPSCIGCKGTHGGTGAGAGAGGAGAGGAGAGGGAGAGGGAGGAGGAGGAGAGGGAGAGGGAGGAGGAGAGGGAGAGGGAGGAGAGGGAGGAGGAGAGGGAGAGGGAGGAGAGGGAGGAGGAGAGGGAGAGGAGGAGGAGAGGAGAGGGAGGAGGAGAGGAGAGGAGAGGAGAGGAGGAGAGGAGGAGAGGAGGAGAGGGAGGAGAGGGAGGAGAGGAGGAGAGGAGGAGAGGAGGAGAGGGAGAGGAGAGGGGRGRGGSGGRGRGGSGGRGRGGSGGRRGRGRERARGGSRERARGRGRGRGEKRPRSPSSQSSSSGSPPRRPPPGRRPFFHPVGEADYFEYHQEGGPDGEPDVPPGAIEQGPADDPGEGPSTGPRGQGDGGRRKKGGWFGKHRGQGGSNPKFENIAEGLRALLARSHVERTTDEGTWVAGVFVYGGSKTSLYNLRRGTALAIPQCRLTPLSRLPFGMAPGPGPQPGPLRESIVCYFMVFLQTHIFAEVLKDAIKDLVMTKPAPTCNIRVTVCSFDDGVDLPPWFPPMVEGAAAEGDDGDDGDEGGDGDEGEEGQE

SEQ ID NO: 319 - protein, 347 aa, Artificial Sequence
  an artificially synthesized sequence
MVLASSTTSIHTMLLLLLMLAQPAMAMKDNTVPLKLIALLANGEFHSGEQLGETLGMSRAAINKHIQTLRDWGVDVFTVPGKGYSLPEPIQLLNAKQILGQLDGGSVAVLPVIDSTNQYLLDRIGELKSGDACIAEYQQAGRGRRGRKWFSPFGANLYLSMFWRLEQGPAAAIGLSLVIGIVMAEVLRKLGADKVRVKWPNDLYLQDRKLAGILVELTGKTGDAAQIVIGAGINMAMRRVEESVVNQGWITLQEAGINLDRNTLAAMLIRELRAALELFEQEGLAPYLSRWEKLDNFINRPVKLIIGDKEIFGISRGIDKQGALLLEQDGIIKPWMGGEISLRSAEK

SEQ ID NO: 320 - protein, 147 aa, Artificial Sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQ

SEQ ID NO: 321 - protein, 25 aa, Artificial Sequence
  an artificially synthesized sequence
GGGGSGGGGSGGGGSGGGGSGGGGS

SEQ ID NO: 322 - protein, 226 aa, Artificial Sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKTSTSGRSANPRGVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 323 - protein, 625 aa, Artificial Sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSTSTSGRSANPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 324 - protein, 625 aa, Artificial Sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSATSTSGRSANPRGSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 325 - protein, 398 aa, Artificial Sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKTSTSGRSANPRGVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 326 - protein, 398 aa, Artificial Sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVTSTSGRSANPRGEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 327 - protein, 398 aa, Artificial Sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVETSTSGRSANPRGIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 328 - protein, 398 aa, Artificial Sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEITSTSGRSANPRGKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 329 - protein, 398 aa, Artificial Sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTSTSGRSANPRGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 330 - protein, 398 aa, Artificial Sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTTSTSGRSANPRGVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 331 - protein, 398 aa, Artificial Sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVTSTSGRSANPRGAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 332 - protein, 398 aa, Artificial Sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVATSTSGRSANPRGAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 333 - protein, 398 aa, Artificial Sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAATSTSGRSANPRGPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 334 - protein, 398 aa, Artificial Sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPTSTSGRSANPRGSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 335-344 - skipped (10 entries)

SEQ ID NO: 345 - protein, 12 aa, Artificial Sequence
  an artificially synthesized sequence
TSTSGRSANPRG

SEQ ID NO: 346-355 - skipped (10 entries)

SEQ ID NO: 356 - protein, 464 aa, Artificial Sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSTSTSGRSANPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 357-366 - skipped (10 entries)

SEQ ID NO: 367 - protein, 474 aa, Artificial Sequence
  an artificially synthesized sequence
QVQLVQSGAEVKKPGSSVTVSCKASGGTFSSFSITWLRQAPGQGLEWMGEITPMFGIANYAQKFQGRVTISADESTSTAYMELSGLTSEDTAMYYCARDGRFDVSDLLTDKPKVTINYNGMDVWGQGTTVTVSSTSTSGRSANPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 368 - protein, 462 aa, Artificial Sequence
  an artificially synthesized sequence
QVQLVQSGAEVKKPGSSVTVSCKASGGTFSSFSITWLRQAPGQGLEWMGEITPMFGIANYAQKFQGRVTISADESTSTAYMELSGLTSEDTAMYYCARDGRFDVSDLLTDKPKVTINYNGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 369 - protein, 216 aa, Artificial Sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 370 - protein, 77 aa, Artificial Sequence
  an artificially synthesized sequence
VPLSRTVRCTCISISNQPVNPRSLEKLEIIPASQFCPRVEIIATMKKKGEKRCLNPESKAIKNLLKAVSKERSKASP

SEQ ID NO: 371 - protein, 302 aa, Artificial Sequence
  an artificially synthesized sequence
VPLSRTVRCTCISISNQPVNPRSLEKLEIIPASQFCPRVEIIATMKKKGEKRCLNPESKAIKNLLKAVSKERSKASPGGGGSGGGGQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 372 - skipped

SEQ ID NO: 373 - protein, 85 aa, Artificial Sequence
  an artificially synthesized sequence
VPLSRTVRCTCISISNQPVNPRSLEKLEIIPASQFCPRVEIIATMKKKGEKRCLNPESKAIKNLLKAVSKERSKASPHHHHHHHH

SEQ ID NO: 374 - protein, 5 aa, Artificial Sequence
  an artificially synthesized sequence
SFSIT

SEQ ID NO: 375 - protein, 17 aa, Artificial Sequence
  an artificially synthesized sequence
EITPMFGIANYAQKFQG

SEQ ID NO: 376 - protein, 25 aa, Artificial Sequence
  an artificially synthesized sequence
DGRFDVSDLLTDKPKVTINYNGMDV

SEQ ID NO: 377 - protein, 13 aa, Artificial Sequence
  an artificially synthesized sequence
SGSSSNIGSNTVN

SEQ ID NO: 378 - protein, 7 aa, Artificial Sequence
  an artificially synthesized sequence
NNDQRPS

SEQ ID NO: 379 - protein, 11 aa, Artificial Sequence
  an artificially synthesized sequence
ASWDDSLNGRV

SEQ ID NO: 380 - protein, 5 aa, Artificial Sequence
  an artificially synthesized sequence
NNGMH

SEQ ID NO: 381 - protein, 17 aa, Artificial Sequence
  an artificially synthesized sequence
VIWFDGMNKFYVDSVKG

SEQ ID NO: 382 - protein, 15 aa, Artificial Sequence
  an artificially synthesized sequence
EGDGSGIYYYYGMDV

SEQ ID NO: 383 - protein, 12 aa, Artificial Sequence
  an artificially synthesized sequence
RASQSVSSSYLA

SEQ ID NO: 384 - protein, 7 aa, Artificial Sequence
  an artificially synthesized sequence
GASSRAT

SEQ ID NO: 385 - protein, 10 aa, Artificial Sequence
  an artificially synthesized sequence
QQYGSSPIFT

SEQ ID NO: 386 - protein, 5 aa, Artificial Sequence
  an artificially synthesized sequence
TYWLG

SEQ ID NO: 387 - protein, 17 aa, Artificial Sequence
  an artificially synthesized sequence
IMSPVDSDIRYSPSFQG

SEQ ID NO: 388 - protein, 10 aa, Artificial Sequence
  an artificially synthesized sequence
RRPGQGYFDF

SEQ ID NO: 389 - protein, 11 aa, Artificial Sequence
  an artificially synthesized sequence
RASQGISSWLA

SEQ ID NO: 390 - protein, 7 aa, Artificial Sequence
  an artificially synthesized sequence
AASSLQS

SEQ ID NO: 391 - protein, 9 aa, Artificial Sequence
  an artificially synthesized sequence
QQYNIYPYT

SEQ ID NO: 392 - protein, 5 aa, Artificial Sequence
  an artificially synthesized sequence
NSGMH

SEQ ID NO: 393 - protein, 17 aa, Artificial Sequence
  an artificially synthesized sequence
VIWYDGSKRYYADSVKG

SEQ ID NO: 394 - protein, 4 aa, Artificial Sequence
  an artificially synthesized sequence
NDDY

SEQ ID NO: 395 - protein, 11 aa, Artificial Sequence
  an artificially synthesized sequence
RASQSVSSYLA

SEQ ID NO: 396 - protein, 7 aa, Artificial Sequence
  an artificially synthesized sequence
DASNRAT

SEQ ID NO: 397 - protein, 9 aa, Artificial Sequence
  an artificially synthesized sequence
QQSSNWPRT

SEQ ID NO: 398 - protein, 6 aa, Artificial Sequence
  an artificially synthesized sequence
SDHAWS

SEQ ID NO: 399 - protein, 16 aa, Artificial Sequence
  an artificially synthesized sequence
YISYSGITTYNPSLKS

SEQ ID NO: 400 - protein, 10 aa, Artificial Sequence
  an artificially synthesized sequence
SLARTTAMDY

SEQ ID NO: 401 - protein, 11 aa, Artificial Sequence
  an artificially synthesized sequence
RASQDISSYLN

SEQ ID NO: 402 - protein, 7 aa, Artificial Sequence
  an artificially synthesized sequence
YTSRLHS

SEQ ID NO: 403 - protein, 9 aa, Artificial Sequence
  an artificially synthesized sequence
QQGNTLPYT

SEQ ID NO: 404 - protein, 459 aa, Artificial Sequence
  an artificially synthesized sequence
QVQLQESTSTSGRSANPRGGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 405 - protein, 459 aa, Artificial Sequence
  an artificially synthesized sequence
QVQLQESGTSTSGRSANPRGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 406 - protein, 459 aa, Artificial Sequence
  an artificially synthesized sequence
QVQLQESGPTSTSGRSANPRGGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 407 - protein, 459 aa, Artificial Sequence
  an artificially synthesized sequence
QVQLQESGPGTSTSGRSANPRGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 408 - protein, 459 aa, Artificial Sequence
  an artificially synthesized sequence
QVQLQESGPGLTSTSGRSANPRGVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 409 - protein, 459 aa, Artificial Sequence
  an artificially synthesized sequence
QVQLQESGPGLVTSTSGRSANPRGRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 410 - protein, 459 aa, Artificial Sequence
  an artificially synthesized sequence
QVQLQESGPGLVRTSTSGRSANPRGPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 411 - protein, 459 aa, Artificial Sequence
  an artificially synthesized sequence
QVQLQESGPGLVRPTSTSGRSANPRGSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 412 - protein, 459 aa, Artificial Sequence
  an artificially synthesized sequence
QVQLQESGPGLVRPSTSTSGRSANPRGQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 413 - protein, 459 aa, Artificial Sequence
  an artificially synthesized sequence
QVQLQESGPGLVRPSQTLSLTCTVSGYSITSDHAWSWVRQPTSTSGRSANPRGPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 414 - protein, 459 aa, Artificial Sequence
  an artificially synthesized sequence
QVQLQESGPGLVRPSQTLSLTCTVSGYSITSDHAWSWVRQPPTSTSGRSANPRGGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 415 - protein, 459 aa, Artificial Sequence
  an artificially synthesized sequence
QVQLQESGPGLVRPSQTLSLTCTVSGYSITSDHAWSWVRQPPGTSTSGRSANPRGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 416 - protein, 459 aa, Artificial Sequence
  an artificially synthesized sequence
QVQLQESGPGLVRPSQTLSLTCTVSGYSITSDHAWSWVRQPPGRTSTSGRSANPRGGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 417 - protein, 459 aa, Artificial Sequence
  an artificially synthesized sequence
QVQLQESGPGLVRPSQTLSLTCTVSGYSITSDHAWSWVRQPPGRGTSTSGRSANPRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 418 - protein, 459 aa, Artificial Sequence
  an artificially synthesized sequence
QVQLQESGPGLVRPSQTLSLTCTVSGYSITSDHAWSWVRQPPGRGLTSTSGRSANPRGEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 419 - protein, 459 aa, Artificial Sequence
  an artificially synthesized sequence
QVQLQESGPGLVRPSQTLSLTCTVSGYSITSDHAWSWVRQPPGRGLEWIGYISYSGTSTSGRSANPRGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 420 - protein, 459 aa, Artificial Sequence
  an artificially synthesized sequence
QVQLQESGPGLVRPSQTLSLTCTVSGYSITSDHAWSWVRQPPGRGLEWIGYISYSGITSTSGRSANPRGTTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 421 - protein, 459 aa, Artificial Sequence
  an artificially synthesized sequence
QVQLQESGPGLVRPSQTLSLTCTVSGYSITSDHAWSWVRQPPGRGLEWIGYISYSGITTSTSGRSANPRGTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 422 - protein, 459 aa, Artificial Sequence
  an artificially synthesized sequence
QVQLQESGPGLVRPSQTLSLTCTVSGYSITSDHAWSWVRQPPGRGLEWIGYISYSGITTTSTSGRSANPRGYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 423 - protein, 459 aa, Artificial Sequence
  an artificially synthesized sequence
QVQLQESGPGLVRPSQTLSLTCTVSGYSITSDHAWSWVRQPPGRGLEWIGYISYSGITTYTSTSGRSANPRGNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 424 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNTSTSGRSANPRGPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 425 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPTSTSGRSANPRGSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 426 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSTSTSGRSANPRGLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 427 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLTSTSGRSANPRGKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 428 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKTSTSGRSANPRGSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 429 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSTSTSGRSANPRGRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 430 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRTSTSGRSANPRGVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 431 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTSTSGRSANPRGTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 432 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTTSTSGRSANPRGMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 433 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTTSTSGRSANPRGSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 434 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSTSTSGRSANPRGKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 435 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKTSTSGRSANPRGNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 436 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNTSTSGRSANPRGQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 437 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQTSTSGRSANPRGFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 438 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTTSTSGRSANPRGAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 439 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTATSTSGRSANPRGADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 440 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAATSTSGRSANPRGDTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 441 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSTSTSGRSANPRGLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 442 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLTSTSGRSANPRGARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 443 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLATSTSGRSANPRGRTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 444 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTSTSGRSANPRGTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 445 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWTSTSGRSANPRGGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 446 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGTSTSGRSANPRGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 447 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQTSTSGRSANPRGGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 448 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGTSTSGRSANPRGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 449 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSTSTSGRSANPRGLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 450 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLTSTSGRSANPRGVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 451 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTSTSGRSANPRGTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 452 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTTSTSGRSANPRGVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 453 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVTSTSGRSANPRGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 454 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSTSTSGRSANPRGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 455 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSTSTSGRSANPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 456 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSATSTSGRSANPRGSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 457 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTSTSGRSANPRGTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 458 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTTSTSGRSANPRGKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 459 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKTSTSGRSANPRGGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 460 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGTSTSGRSANPRGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 461 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPTSTSGRSANPRGSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 462 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSTSTSGRSANPRGVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 463 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLATSTSGRSANPRGPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 464 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPTSTSGRSANPRGSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 465 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSTSTSGRSANPRGSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 466 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSTSTSGRSANPRGKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 467 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSTSGRSANPRGTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 468 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTTSTSGRSANPRGSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 469 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGTSTSGRSANPRGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 470 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTTSTSGRSANPRGAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 471 - protein, 226 aa, Artificial Sequence
  an artificially synthesized sequence
DIQMTQSTSTSGRSANPRGPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 472 - protein, 226 aa, Artificial Sequence
  an artificially synthesized sequence
DIQMTQSPTSTSGRSANPRGSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 473 - protein, 226 aa, Artificial Sequence
  an artificially synthesized sequence
DIQMTQSPSTSTSGRSANPRGSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 474 - protein, 226 aa, Artificial Sequence
  an artificially synthesized sequence
DIQMTQSPSSTSTSGRSANPRGLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 475 - protein, 226 aa, Artificial Sequence
  an artificially synthesized sequence
DIQMTQSPSSLTSTSGRSANPRGSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 476 - protein, 226 aa, Artificial Sequence
  an artificially synthesized sequence
DIQMTQSPSSLSTSTSGRSANPRGASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 477 - protein, 226 aa, Artificial Sequence
  an artificially synthesized sequence
DIQMTQSPSSLSATSTSGRSANPRGSVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 478 - protein, 226 aa, Artificial Sequence
  an artificially synthesized sequence
DIQMTQSPSSLSASTSTSGRSANPRGVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 479 - protein, 226 aa, Artificial Sequence
  an artificially synthesized sequence
DIQMTQSPSSLSASVTSTSGRSANPRGGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 480 - protein, 226 aa, Artificial Sequence
  an artificially synthesized sequence
DIQMTQSPSSLSASVGTSTSGRSANPRGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 481 - protein, 226 aa, Artificial Sequence
  an artificially synthesized sequence
DIQMTQSPSSLSASVGDTSTSGRSANPRGRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 482 - protein, 226 aa, Artificial Sequence
  an artificially synthesized sequence
DIQMTQSPSSLSASVGDRTSTSGRSANPRGVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 483 - protein, 226 aa, Artificial Sequence
  an artificially synthesized sequence
DIQMTQSPSSLSASVGDRVTITCRASQDISSYLNWYQQKTSTSGRSANPRGPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 484 - protein, 226 aa, Artificial Sequence
  an artificially synthesized sequence
DIQMTQSPSSLSASVGDRVTITCRASQDISSYLNWYQQKPTSTSGRSANPRGGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 485 - protein, 226 aa, Artificial Sequence
  an artificially synthesized sequence
DIQMTQSPSSLSASVGDRVTITCRASQDISSYLNWYQQKPGTSTSGRSANPRGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 486 - protein, 226 aa, Artificial Sequence
  an artificially synthesized sequence
DIQMTQSPSSLSASVGDRVTITCRASQDISSYLNWYQQKPGKTSTSGRSANPRGAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 487 - protein, 226 aa, Artificial Sequence
  an artificially synthesized sequence
DIQMTQSPSSLSASVGDRVTITCRASQDISSYLNWYQQKPGKATSTSGRSANPRGPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 488 - protein, 226 aa, Artificial Sequence
  an artificially synthesized sequence
DIQMTQSPSSLSASVGDRVTITCRASQDISSYLNWYQQKPGKAPTSTSGRSANPRGKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 489 - protein, 226 aa, Artificial Sequence
  an artificially synthesized sequence
DIQMTQSPSSLSASVGDRVTITCRASQDISSYLNWYQQKPGKAPKTSTSGRSANPRGLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 490 - protein, 226 aa, Artificial Sequence
  an artificially synthesized sequence
DIQMTQSPSSLSASVGDRVTITCRASQDISSYLNWYQQKPGKAPKLLIYTSTSGRSANPRGYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 491 - protein, 226 aa, Artificial Sequence
  an artificially synthesized sequence
DIQMTQSPSSLSASVGDRVTITCRASQDISSYLNWYQQKPGKAPKLLIYYTSTSGRSANPRGTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 492 - protein, 226 aa, Artificial Sequence
  an artificially synthesized sequence
DIQMTQSPSSLSASVGDRVTITCRASQDISSYLNWYQQKPGKAPKLLIYYTTSTSGRSANPRGSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 493 - protein, 226 aa, Artificial Sequence
  an artificially synthesized sequence
DIQMTQSPSSLSASVGDRVTITCRASQDISSYLNWYQQKPGKAPKLLIYYTSTSTSGRSANPRGRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 494 - protein, 226 aa, Artificial Sequence
  an artificially synthesized sequence
DIQMTQSPSSLSASVGDRVTITCRASQDISSYLNWYQQKPGKAPKLLIYYTSRTSTSGRSANPRGLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 495 - protein, 226 aa, Artificial Sequence
  an artificially synthesized sequence
DIQMTQSPSSLSASVGDRVTITCRASQDISSYLNWYQQKPGKAPKLLIYYTSRLTSTSGRSANPRGHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 496 - protein, 226 aa, Artificial Sequence
  an artificially synthesized sequence
DIQMTQSPSSLSASVGDRVTITCRASQDISSYLNWYQQKPGKAPKLLIYYTSRLHTSTSGRSANPRGSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 497 - protein, 226 aa, Artificial Sequence
  an artificially synthesized sequence
DIQMTQSPSSLSASVGDRVTITCRASQDISSYLNWYQQKPGKAPKLLIYYTSRLHSTSTSGRSANPRGGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 498 - protein, 226 aa, Artificial Sequence
  an artificially synthesized sequence
DIQMTQSPSSLSASVGDRVTITCRASQDISSYLNWYQQKPGKAPKLLIYYTSRLHSGTSTSGRSANPRGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 499 - protein, 226 aa, Artificial Sequence
  an artificially synthesized sequence
DIQMTQSPSSLSASVGDRVTITCRASQDISSYLNWYQQKPGKAPKLLIYYTSRLHSGVTSTSGRSANPRGPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 500 - protein, 226 aa, Artificial Sequence
  an artificially synthesized sequence
DIQMTQSPSSLSASVGDRVTITCRASQDISSYLNWYQQKPGKAPKLLIYYTSRLHSGVPTSTSGRSANPRGSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 501 - protein, 226 aa, Artificial Sequence
  an artificially synthesized sequence
DIQMTQSPSSLSASVGDRVTITCRASQDISSYLNWYQQKPGKAPKLLIYYTSRLHSGVPSTSTSGRSANPRGRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 502 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTSTSGRSANPRGTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 503 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTTSTSGRSANPRGFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 504 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFTSTSGRSANPRGGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 505 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGTSTSGRSANPRGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 506 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQTSTSGRSANPRGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 507 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTSTSGRSANPRGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 508 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTTSTSGRSANPRGKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 509 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKTSTSGRSANPRGVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 510 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVTSTSGRSANPRGEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 511 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVETSTSGRSANPRGIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 512 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEITSTSGRSANPRGKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 513 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKTSTSGRSANPRGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 514 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTSTSGRSANPRGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 515 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTTSTSGRSANPRGVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 516 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVTSTSGRSANPRGAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 517 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVATSTSGRSANPRGAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 518 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAATSTSGRSANPRGPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 519 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPTSTSGRSANPRGSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 520 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVTSTSGRSANPRGFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 521 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFTSTSGRSANPRGIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 522 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFITSTSGRSANPRGFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 523 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFTSTSGRSANPRGPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 524 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPTSTSGRSANPRGPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 525 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPTSTSGRSANPRGSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 526 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSTSTSGRSANPRGDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 527 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDTSTSGRSANPRGEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 528 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDETSTSGRSANPRGQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 529 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQTSTSGRSANPRGLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 530 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLTSTSGRSANPRGKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 531 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKTSTSGRSANPRGSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 532 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSTSTSGRSANPRGGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 533 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTSTSGRSANPRGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 534 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTTSTSGRSANPRGASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 535 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTATSTSGRSANPRGSVVCLLNNFYPREAKVQWKVDNALQSGNSQESVTEQDSKDSTYSLSSTLTLSKADYEKHKVYACEVTHQGLSSPVTKSFNRGEC

SEQ ID NO: 536 - protein, 19 aa, Artificial Sequence
  an artificially synthesized sequence
MGWSCIILFLVATATGVHS

SEQ ID NO: 537 - protein, 6 aa, Homo sapiens
MYPPPY

The invention claimed is:

1. A ligand binding molecule which is a molecule capable of binding to a ligand, wherein the molecule is a polypeptide having at least one cleavage site, and the ligand binding of the molecule cleaved at the at least one cleavage site is attenuated, wherein the ligand is:
    (a) a cytokine or a chemokine;
    (b) selected from an interleukin, an interferon, a hematopoietic factor, a member of the TNF superfamily, a chemokine, a cell growth factor, and a member of the TGF-β family; or
    (c) CXCL10, IL12, PD1, or IL6R.
2. The ligand binding molecule according to claim 1, wherein the at least one cleavage site comprises a protease cleavage sequence.
3. The ligand binding molecule according to claim 2, wherein the protease cleavage sequence is cleavable by a target tissue specific protease.
4. The ligand binding molecule according to claim 1, wherein the ligand binding molecule comprises an antibody VH, an antibody VL, and an antibody constant region.
5. The ligand binding molecule according to claim 4, wherein the cleavage site or the protease cleavage sequence is located near the boundary between the antibody constant region and the antibody VH and/or near the boundary between the antibody constant region and the antibody VL.
6. The ligand binding molecule of according to claim 4, wherein the antibody VL and the antibody VH are associated with each other, and wherein the association is canceled by cleavage of the cleavage site or canceled by the protease cleavage of the protease cleavage sequence.
7. The ligand binding molecule according to claim 1, wherein the ligand is a molecule having biological activity, and the ligand binding molecule inhibits the biological activity of the ligand by binding to the ligand.
8. The ligand binding molecule according to claim 1, wherein the ligand binding molecule is an IgG antibody.
9. The ligand binding molecule according to claim 1, wherein the ligand binding molecule is bound with the ligand.
10. The ligand binding molecule according to claim 1, wherein the ligand binding molecule is fused with the ligand.

11. A pharmaceutical composition comprising the ligand binding molecule according to claim 1.
12. A pharmaceutical composition comprising the ligand binding molecule according to claim 1 and the ligand.
13. A pharmaceutical composition comprising a fusion protein comprising the ligand binding molecule according to claim 1 fused with the ligand.
14. The ligand binding molecule according to claim 2,
    (a) wherein a first flexible linker is attached to one end of the protease cleavage sequence, optionally wherein the first flexible linker consists of a glycine-serine polymer; or
    (b) wherein a first flexible linker is attached to one end of the protease cleavage sequence and wherein a second flexible linker is attached to the other end of the protease cleavage sequence, optionally wherein the second flexible linker consists of a glycine-serine polymer.
15. The ligand binding molecule according to claim 2,
    (a) wherein the protease is a cancer tissue specific protease, an inflammatory tissue specific protease, or at least one protease selected from matriptase, urokinase (uPA), and metalloproteinase; or
    (b) wherein the protease cleavage sequence comprised in the ligand binding molecule comprises a sequence selected from the sequences represented by SEQ ID NOs: 3, 34, 66, 70, 71, 72, 73, 35, 75, 76, and 345.
16. The ligand binding molecule according to claim 14, which comprises the first flexible linker and the second flexible linker and wherein:
    (a) the protease cleavage sequence, the protease cleavage sequence and the first flexible linker, or the protease cleavage sequence and the first flexible linker and the second flexible linker is located within the antibody constant region;
    (b) the protease cleavage sequence, the protease cleavage sequence and the first flexible linker, or the protease cleavage sequence and the first flexible linker and the second flexible linker is inserted at any position in a sequence from antibody heavy chain constant region amino acid position 118 (EU numbering) to antibody heavy chain constant region amino acid position 140 (EU numbering);

(c) the protease cleavage sequence, the protease cleavage sequence and the first flexible linker, or the protease cleavage sequence and the first flexible linker and the second flexible linker is inserted at any position in a sequence from antibody light chain constant region amino acid position 108 (EU numbering) (Kabat numbering position 108) to antibody light chain constant region amino acid position 131 (EU numbering) (Kabat numbering position 131);

(d) the protease cleavage sequence, the protease cleavage sequence and the first flexible linker, or the protease cleavage sequence, the first flexible linker, and the second flexible linker are located within the antibody VH or within the antibody VL;

(e) the protease cleavage sequence, the protease cleavage sequence and the first flexible linker, or the protease cleavage sequence and the first flexible linker and the second flexible linker is inserted at any position in a sequence selected from the group consisting of a sequence from amino acid position 7 (Kabat numbering) to amino acid position 16 (Kabat numbering), a sequence from amino acid position 40 (Kabat numbering) to amino acid position 47 (Kabat numbering), a sequence from amino acid position 55 (Kabat numbering) to amino acid position 69 (Kabat numbering), a sequence from amino acid position 73 (Kabat numbering) to amino acid position 79 (Kabat numbering), a sequence from amino acid position 83 (Kabat numbering) to amino acid position 89 (Kabat numbering), a sequence from amino acid position 95 (Kabat numbering) to amino acid position 99 (Kabat numbering), and a sequence from amino acid position 101 (Kabat numbering) to amino acid position 113 (Kabat numbering) in the antibody VH;

(f) the protease cleavage sequence, the protease cleavage sequence and the first flexible linker, or the protease cleavage sequence and the first flexible linker and the second flexible linker is inserted at any position in a sequence selected from the group consisting of a sequence from amino acid position 7 (Kabat numbering) to amino acid position 19 (Kabat numbering), a sequence from amino acid position 39 (Kabat numbering) to amino acid position 46 (Kabat numbering), a sequence from amino acid position 49 (Kabat numbering) to amino acid position 62 (Kabat numbering), and a sequence from amino acid position 96 (Kabat numbering) to amino acid position 107 (Kabat numbering) in the antibody VL;

(g) the protease cleavage sequence, the protease cleavage sequence and the first flexible linker, or the protease cleavage sequence and the first flexible linker and the second flexible linker is located near the boundary between the antibody constant region and the antibody VH or/and near the boundary between the antibody constant region and the antibody VL;

(h) the protease cleavage sequence, or the protease cleavage sequence and the first flexible linker, or the protease cleavage sequence and the first flexible linker and the second flexible linker is inserted at any position in a sequence from antibody VH amino acid position 109 (Kabat numbering) to antibody heavy chain constant region amino acid position 122 (EU numbering); or (i) the protease cleavage sequence, the protease cleavage sequence and the first flexible linker, or the protease cleavage sequence and the first flexible linker and the second flexible linker is inserted at any position in a sequence from antibody VL amino acid position 104 (Kabat numbering) to antibody light chain constant region amino acid position 113 (EU numbering) (Kabat numbering position 113).

17. The ligand binding molecule of claim 10, wherein the ligand binding molecule is fused with the ligand via a linker, optionally wherein the linker consists of a glycine-serine polymer, optionally wherein the linker does not comprise a protease cleavage sequence.

18. The ligand binding molecule according to claim 17, wherein the ligand binding molecule comprises an antibody light chain and an antibody heavy chain, wherein the antibody light chain or the antibody heavy chain is fused with the ligand, optionally wherein the cleavage site is contained in the antibody light chain or the antibody heavy chain.

19. A method for producing a fusion protein comprising the ligand binding molecule according to claim 1 with its ligand, comprising fusing a ligand binding molecule having a protease cleavage sequence with its ligand.

20. The ligand binding molecule according to claim 1, wherein the ligand is IL12.

21. The ligand binding molecule according to claim 16 wherein the protease cleavage sequence, or the protease cleavage sequence and the first flexible linker, or the protease cleavage sequence and the first flexible linker and the second flexible linker is inserted at any position in a sequence from antibody VH amino acid position 109 (Kabat numbering) to antibody heavy chain constant region amino acid position 122 (EU numbering).

22. The ligand binding molecule according to claim 1, wherein the ligand is IL12 and the at least one cleavage site comprises a protease cleavage sequence, wherein a first flexible linker is attached to one end of the protease cleavage sequence and wherein a second flexible linker is attached to the other end of the protease cleavage sequence, and wherein the protease cleavage sequence, or the protease cleavage sequence and the first flexible linker, or the protease cleavage sequence and the first flexible linker and the second flexible linker is inserted at any position in a sequence from antibody VH amino acid position 109 (Kabat numbering) to antibody heavy chain constant region amino acid position 122 (EU numbering), optionally wherein the second flexible linker consists of a glycine-serine polymer.

23. The ligand binding molecule according to claim 20, wherein the protease is matriptase and the protease cleavage sequence comprised in the ligand binding molecule comprises the sequence represented by SEQ ID NO:345.

* * * * *